United States Patent
Falb et al.

(10) Patent No.: US 11,384,359 B2
(45) Date of Patent: *Jul. 12, 2022

(54) BACTERIA ENGINEERED TO TREAT DISEASES THAT BENEFIT FROM REDUCED GUT INFLAMMATION AND/OR TIGHTENED GUT MUCOSAL BARRIER

(71) Applicant: Synlogic Operating Company, Inc., Cambridge, MA (US)

(72) Inventors: Dean Falb, Sherborn, MA (US); Vincent M. Isabella, Watertown, MA (US); Jonathan W. Kotula, Somerville, MA (US); Paul F. Miller, Salem, CT (US); Yves Millet, Newton, MA (US); Adam Fisher, Cambridge, MA (US)

(73) Assignee: SYNLOGIC OPERATING COMPANY, INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/260,319

(22) Filed: Sep. 8, 2016

(65) Prior Publication Data

US 2017/0067065 A1  Mar. 9, 2017

Related U.S. Application Data

(63) Continuation-in-part of application No. PCT/US2016/020530, filed on Mar. 2, 2016, which is a continuation of application No. 14/998,376, filed on Dec. 22, 2015, now abandoned.

(60) Provisional application No. 62/291,461, filed on Feb. 4, 2016, provisional application No. 62/291,470, filed on Feb. 4, 2016, provisional application No. 62/291,468, filed on Feb. 4, 2016, provisional application No. 62/256,048, filed on Nov. 16, 2015, provisional application No. 62/256,042, filed on Nov. 16, 2015, provisional application No. 62/256,044, filed on Nov. 16, 2015, provisional application No. 62/248,825, filed on Oct. 30, 2015, provisional application No. 62/248,805, filed on Oct. 30, 2015, provisional application No. 62/248,814, filed on Oct. 30, 2015, provisional application No. 62/184,770, filed on Jun. 25, 2015, provisional application No. 62/127,131, filed on Mar. 2, 2015, provisional application No. 62/127,097, filed on Mar. 2, 2015.

(51) Int. Cl.

| *C12N 15/70* | (2006.01) |
| *C12N 9/02* | (2006.01) |
| *C12N 9/12* | (2006.01) |
| *A61K 35/741* | (2015.01) |
| *A61K 38/20* | (2006.01) |
| *A61K 38/26* | (2006.01) |
| *A61K 38/44* | (2006.01) |
| *A61K 31/19* | (2006.01) |
| *A61K 31/198* | (2006.01) |
| *A61K 35/00* | (2006.01) |

(52) U.S. Cl.
CPC .............. *C12N 15/70* (2013.01); *A61K 31/19* (2013.01); *A61K 31/198* (2013.01); *A61K 35/741* (2013.01); *A61K 38/20* (2013.01); *A61K 38/2013* (2013.01); *A61K 38/2066* (2013.01); *A61K 38/26* (2013.01); *A61K 38/446* (2013.01); *C12N 9/001* (2013.01); *C12N 9/1217* (2013.01); *C12Y 103/08001* (2013.01); *C12Y 115/01001* (2013.01); *C12Y 207/02007* (2013.01); *A61K 2035/115* (2013.01); *Y02A 50/30* (2018.01)

(58) Field of Classification Search
CPC .............. A61K 2035/115; A61K 31/19; A61K 31/198; A61K 35/741; A61K 38/20; A61K 38/2013; A61K 38/2066; A61K 38/26; A61K 38/446; C12N 15/70; C12N 9/001; C12N 9/1217; C12Y 103/08001; C12Y 115/01001; C12Y 207/02007
USPC ....................................................... 424/200.1
See application file for complete search history.

(56) References Cited

U.S. PATENT DOCUMENTS

| 5,589,168 | A | 12/1996 | Allen et al. |
| 5,989,463 | A | 11/1999 | Tracy et al. |
| 6,203,797 | B1 | 3/2001 | Perry |
| 6,835,376 | B1 | 12/2004 | Neeser et al. |
| 7,731,976 | B2 | 6/2010 | Cobb et al. |
| 8,048,661 | B2 * | 11/2011 | Burgard ................. C12N 9/001 435/183 |
| 9,487,764 | B2 | 11/2016 | Falb et al. |
| 2004/0229338 | A1 | 11/2004 | King |
| 2013/0302844 | A1 | 11/2013 | Ikegami et al. |
| 2015/0139940 | A1 | 5/2015 | Bermudez Humaran et al. |
| 2016/0143961 | A1 * | 5/2016 | Berry ................... A61K 9/0031 424/93.3 |

(Continued)

FOREIGN PATENT DOCUMENTS

| CN | 1560256 | 1/2005 |
| EP | 1 383 897 B1 | 6/2006 |

(Continued)

OTHER PUBLICATIONS

Monte et al. Cytokine 55 (2011) 62-73. (Year: 2011).*

(Continued)

*Primary Examiner* — Janet L Epps-Smith
(74) *Attorney, Agent, or Firm* — Synlogic/Finnegan

(57) ABSTRACT

Genetically engineered bacteria, pharmaceutical compositions thereof, and methods of treating or preventing autoimmune disorders, inhibiting inflammatory mechanisms in the gut, and/or tightening gut mucosal barrier function are disclosed.

18 Claims, 123 Drawing Sheets

Specification includes a Sequence Listing.

(56) References Cited

U.S. PATENT DOCUMENTS

| | | | |
|---|---|---|---|
| 2016/0177274 A1 | 6/2016 | Falb et al. | |
| 2016/0206666 A1 | 7/2016 | Falb et al. | |
| 2016/0287670 A1* | 10/2016 | Van Den Brink | A61K 38/20 |
| 2016/0340665 A1 | 11/2016 | Falb et al. | |
| 2017/0014457 A1 | 1/2017 | Falb et al. | |
| 2017/0067065 A1 | 3/2017 | Falb et al. | |
| 2017/0128499 A1* | 5/2017 | Falb | C12N 9/001 |
| 2017/0137789 A9 | 5/2017 | Falb et al. | |
| 2017/0253862 A1 | 9/2017 | Falb et al. | |
| 2018/0117099 A1 | 5/2018 | Chatila et al. | |

FOREIGN PATENT DOCUMENTS

| | | | |
|---|---|---|---|
| EP | 2 344 626 B1 | 3/2017 | |
| JP | 2004533246 A | 11/2004 | |
| RU | 2466185 C2 | 11/2012 | |
| WO | WO-9215688 A1 * | 9/1992 | C07K 14/235 |
| WO | WO 2006/079790 A2 | 8/2006 | |
| WO | WO 2013/175358 A1 | 11/2013 | |
| WO | WO 2014/093852 A1 | 8/2014 | |
| WO | WO 2014/138324 A1 | 9/2014 | |
| WO | WO 2016/106343 A1 | 6/2016 | |
| WO | WO2016141108 A1 | 9/2016 | |

OTHER PUBLICATIONS

Sugimoto et al. J. Clin. Invest. 118(2):534-544. (2008) (Year: 2008).*

Aboulnaga, E-H. et al. (2013) "of an Oxygen-Tolerant Bifurcating Butyryl Coenzyme A Dehydrogenase/Electron-Transferring Flavoprotein Complex from *Clostridium difficile* on Butyrate Production in *Escherichia coli*" *J Bacteriol*, 195(16):3704-3713.

Ahmad, Z.A. et al. (2012) "scFv Antibody: Principles and Clinical Application" *Clin Dev Immunol*, 2012:980250 (15 pages).

Albiniak, A.M. et al. (2013) "High-level secretion of a recombinant protein to the culture medium with a *Bacillus subtilis* twin-arginine translocation system in *Escherichie coli*" *FEBS J*, 280:3810-3821.

Altenhoefer et al. (Apr. 9, 2004) "The probiotic *Escherichia coli* strain Nissle 1917 interferes with invasion of human intestinal epithelial cells by different enteroinvasive bacterial pathogens" *FEMS Immunol Med Microbiol*, 40(3):223-229.

Andersen, P.S. et al. (Apr. 1995) "Uracil uptake in *Escherichia coli* K-12: isolation of uraA mutants and cloning of the gene" *J Bacteriol*, 177(81):2008-2013.

Archer, E.J. et al. (Oct. 2012) "Engineered *E. coli* That Detect and Respond to Gut Inflammation through Nitric Oxide Sensing" *ACS Synthetic Biology*, 1(10):451-457.

Arpaia, N. et al. (Nov. 2013) "Metabolites produced by commensal bacteria promote peripheral regulatory T-cell generation" *Nature*, doi:10.1038/nature12726 (6 pages). Final publication in 504(7480):451-455.

Arrieta et al. (Sep. 30, 2015) "Early infancy microbial and metabolic alterations affect risk of childhood asthma" *Sci Transl Med*, 7(307):307ra152 (16 pages).

Arthur et al. (Oct. 5, 2012) "Intestinal inflammation targets cancer-inducing activity of the miorobiota" *Science*, 338(6103):120-123. NIH Public Access Author Manuscript; available in PMC May 6, 2013 (11 pages).

Atarashi, K. at al. (Jan. 2011) "Induction of colonic regulatory T cells by indigenous *Clostridium* species" Science, 331(6015):337-341. NIH Public Access Author Manuscript: available in PMC Mar. 28, 2014 (10 pages).

Brophy, J.A.N. et al. (May 2014) "Principles of genetic circuit design" *Nature Methods*, 11(5):508-520. NIH Public Access Author Manuscript: available in PMC Nov. 13, 2014 (30 pages).

Callura et al. (Sep. 7, 2010) "Tracking, tuning, and terminating microbial physiology using synthetic riboregulators" *Proc Natl Acad Sci USA*, 107(36):15898-15903.

Castiglione et al. (Sep. 2009) "The transcripton factor DNR from *Pseudomones aeruginose* specifically requires nitric oxide and haem for the activation of a target promoter in *Escherichia coli*" *Microbiology*, 155(Pt 9):2836-2844.

Clarkson et al. (1971) "Diaminopimelic Acid and Lysine Auxotrophs of *Pseudomonas aeruginosa* 8602" *J Gen Microbiol*, 66:161-169.

Cohen, L.B. et al. (Jun. 2014) "Biologic therapies in inflammatory bowel disease" *Transl Res*, 163(6):533-556.

Collinson, I. et al. (2015) "Channel crossing: how are proteins shipped across the bacterial plasma membrane48 "*Philos Trans R Soc B*, 370:20150025 [online]. Retrieved from: http://rstb.royalsocietypublishing.org/, on Jun. 16, 2016 (13 pages).

Costa, T.R.D. et al. (2015) "Secretion systems in Gram-negative bacteria: structural and mechanistic insights" *Nat Rev Microbiol*, 13(6):343-359.

Cuevas-Ramos et al. (Jun. 22, 2010) "*Escherichia coli* induces DNA damage in vivo and triggers genomic instability in mammalian cells" *Proc Natl Acad Sci USA*, 107(25):11537-11542.

Davis-Richardson, A.G. and E.W. Triplett (Jul. 2015) "A model for the role of gut bacteria in the development of autoimmunity for type 1 diabetes" *Diabetologia*, 58(7):1386-1393.

Dinleyici et al. (Nov. 2014) "*Saccharomyces boulardii* CNCM I-745 in different clinical conditions" *Expert Opin Biol Ther*, 14(11):1593-1609.

Dunn, A.K. et al. (Jul. 2010) "The alternative oxidase (AOX) gene in *Vibrio fischeri* is controlled by NsrR and upregulated in response to nitric oxide" *Mol Microbiol*, 77(1):44-55. NIH Public Access Author Manuscript; available in PMC Jun. 14, 2013 (24 pages).

Fasano, A. and T. Shea-Donohue (Sep. 2005) "Mechanisms of disease: the role of intestinal barrier function in the pathogenesis of gastrointestinal autoimmune diseases" *Nat Clin Pract Gastroenterol Hepatol*, 2(9):416-422.

Fasano, A. (Feb. 2012) "Leaky gut and autoimmune diseases" *Clin Rev Allergy Immunol*, 42(1):71-78.

Frenzel, A. et al. (Jul. 2013) "Expression of recombinant antibodies" *Front Immunol*, 4:217 (20 pages).

Furusawa, Y. et al. (2013) "Commensal microbe-derived butyrate induces the differentiation of colonic regulatory T cells" *Nature*, doi:10.1088/nature12721 (7 pages). Final Publication in 504:446-450.

Gardner et al. (2000) "Construction of a genetic toggle switch in *Escherichia coli*" Nature, 403:339-342.

Gerdes et al. (Oct. 2006) "Essential genes on metabolic maps" *Curr Opin Biotechnol*, 17(5):448-456.

Gerlach, R.G. and M. Hensel (2007) "Protein secretion systems and adhesins: The molecular armory of Gram-negative pathogens" *Int J Med Microbiol*, 297:401-415.

Ghishan, F.K. and P.R. Kiela (Jun. 2014) "Epithelial transport in inflammatory bowel diseases" *Inflamm Bowel Dis*, 20(6):1099-1109. NIH Public Access Author Manuscript; available in DAAC Jun. 1 2015 (22 pages)/

Giardina, G. et al. (2008) "NO sensing in Pseudomonas aeruginosa: Structure of the Transcriptional Regulator DNR" *J Mol Biol*, 378:1002-1015.

Giardina, G. et al. (Oct. 2009) "A dramatic conformational rearrangement is necessary for the activation of DNR from *Pseudomonas aeruginosa*. Crystal structure of wild-type DNR" *Proteins*, 77(1):174-180.

Hamer, H.M. et al. (Jan. 2008) "Review article: the role of butyrate on colonic function" *Aliment Pharmacol Ther*, 27(2):104-119.

Hetzel, M. et al. (2003) "Acryloyl-CoA reductase from *Clostridium propionicum*. An enzyme complex of propionyl-CoA dehydrogenase and electron-transferring flavoprotein" *Eur J Biochem*, 270:902-910.

Hristodorov, D. et al. (Sep.-Oct. 2014) "Recombinant H22(scFv) blocks CD64 and prevents the capture of anti-TNF monoclonal antibody. A potential strategy to enhance anti-TNF therapy" mAbs, 6(5):1283-1289.

Ianiro, G. et al. (Oct. 2014) "Fecal microbiota transplantation in inflammatory bowel disease: beyond the excitement" *Medicine*, 93(19):e97 (11 pages).

International Patent Application No. PCT/US2015/067435, filed Dec. 22, 2015, by Massachusetts Institute of Technology: International Search Report and Written Opinion, dated Jun. 13, 2016.

(56) References Cited

OTHER PUBLICATIONS

International Patent Application No. PCT/US2016/020530, filed Mar. 2, 2016, by Synlogic, Inc.: International Search Report and Written Opinion, dated Jun. 24, 2016.
Isabella, V.M. et al. (2009; online Nov. 6, 2008) "Functional analysis of NstR, a nitric oxide-sensing Rrf2 repressor in *Neisseria gonorrhoeae*" *Mol Microbiol*, 71(1):227-239.
Karlinsey, J. et al. (Sep. 2012) "The NsrR Regulon in Nitrosative Stress Resistance of *Salmonella enterica* serovar Typhimurium" *Mol Microbiol*, 85(6): 1179-1193. NIH Public Access Author Manuscript; available in PMC Sep. 1. 2013 (24 pages).
Keates, A.C. et al. (2008) "TransKingdom RNA interference: a bacterial approach to challenges in RNAi therapy and delivery" *Biotechnol Genet Eng Rev*, 25:113-128.
Kleman, G.L. and W.R. Strohl (Nov. 1994) "Acetate metabolism by *Escherichia coli* in high-cell-density fermentation" *Appl Environ Microbiol*, 60(11):3952-3958.
Kobayashi, H. et al. (Jun. 2004) "Programmable cells: Interfacing natural and engineered networks" *PNAS*, 101(22):8414-8419.
Kotula, J.W. et al. (Apr. 2014) "Programmable bacteria detect and record an environmental signal in the mammalian gut" *PNAS*, 111(13):4838-4843, with Supporting Information (11 pages).
Lerner, A. and T. Matthias (Jun. 2015) "Changes in intestinal tight junction permeability associated with industrial food additives explain the rising incidence of autoimmune disease" *Autoimmun Rev*, 14(6):479-489.
Lerner, A. and T. Matthias (Nov. 2015) "Rheumatoid arthritis-celiac disease relationship: Joints get that gut feeling" *Autoimmun Rev*, 14(11):1038-1047.
Lopez, G. and J.C. Anderson (Dec. 2015) "Synthetic Auxotrophs with Ligand-Dependent Essential Genes for a BL21(DE3) Biosafety Strain" *ACS Synthetic Bioiogy*, 4(12):1279-1286.
Meadow, P. and E. Work (1959) "Biosynthesis of diaminopimelic acid and lysine in *Escherichia coil*" *Biochem J*, 72(3):396-400.
Mizoguchi, A. (2012) "Animal models of inflammatory bowel disease" *Prog Mol Biol Transl Sci*, 105:263-320.
Nielsen, O.H. (Mar. 2014) "New strategies for treatment of inflammatory bowel disease" *Front Med*, 1:3 (5 pages).
Nougayrede et al. (Aug. 11, 2006) "*Escherichia coli* induces DNA double-strand breaks in eukaryotic cells" *Science*, 313(5788):848-851.
Olier et al. (Nov.-Dec. 2012) "Genotoxicity of *Escherichia coli* Nissle 1917 strain cannot be dissociated from its probiotic activity" *Gut Microbes*, 3(6):501-509.
Paun, A. and J.S. Danska (Oct. 10, 2015) "Immuno-ecology: how the microbiome regulates tolerance and autoimmunity" *Curr Opin Immunol*, 37:34-39.
Pugsley, A.P. (Mar. 1993) "The complete general secretory pathway in gram-negative bacteria" *Microbiol Rev*, 57(1):50-108.
Purcell, O. et al. (2013) "Towards a whole-cell modeling approach for synthetic biology" *Chaos*, 23(2):025112 (8 pages).
Ragsdale, S.W. (Mar. 2008) "Enzymology of the Wood-Ljungdahl Pathway of Acetogenesis" *Ann NY Acad Sci*, 1125:129-136. NIH Public Access Author Manuscrint available in PMC Feb. 16, 2011 (15 pages).
Reeves, A.Z. et al. (Apr. 2015) "Engineering *E. coli* into a protein delivery system for mammalian cells" *ACS Synth Biol*, Just Accepted Manuscript, DOI: 10.1021/acssynbio.5b00002 [online]. Retrieved from: http://pubs.acs.org, on Apr. 20, 2015 (26 pages). Final publication in vol. 5, pp. 644-654.
Reister et al. (Oct. 10, 2014) "Complete genome sequence of the Gram-negative probiotic *Escherichia coli* strain Nissle 1917" *J Biotechnol*, 187:106-107.
Rembacken et al. (Aug. 21, 1999) "Non-pathogenic *Escherichia coli* versus mesalazine for the treatment of ulcerative colitis: a randomised trial" *Lancet*, 354(9179):635-639.
Rigel, N.W. and Braunstein (2008) "A new twist on an old pathway—accessory secretion systems" *Mol Microbiol*, 69(2):291-302.

Roquet, N. et al. (May 2014) "Digital and analog gene circuits for biotechnology" *Biotechnol J*, 9(5):597-608. NIH Public Access Author Manuscript; avallable in PMC May 1, 2015 (22 pages).
Saier Jr., M.H. (2006) "Protein Secretion and Membrane Insertion Systems in Gram-Negative Bacteria" *J Membrane Biol*, 214:75-90.
Sanz, Y. and A. Moya-Pérez (2014) "Microbiota, inflammation and obesity" *Adv Exp Med Biol*, 817:291-317.
Sanz, Y. et al., (Jan. 2015) "Understanding the role of gut microbiome in metabolic disease risk" *Pediatr Res*, 77(1-2):236-244.
Sat et al. (Mar. 2003) "The *Escherichia coli mazEF* suicide module mediates thymineless death" *J Bacteriol*, 185(6):1803-1807.
Schiel-Bengelsdorf, B. and P. Dürre (2012) "Pathway engineering and synthetic biology using acetogens" *FEBS Letters*, 586:2191-2198.
Schreiber, K. et al. (Jun. 2007) "The Anaerobic Regulatory Network Required for *Pseudomonas aeruginosa* Nitrate Respiration" *J Bacteriol*, 189(11):4310-4314.
Schultz (Jul. 2008) "Clinical use of *E. coli* Nissle 1917 in inflammatory bowel disease" *Inflamm Bowel Dis*, 14(7):1012-1018.
Selmer, T. et al. (2002) "Propionate CoA-transferase from *Clostridium propionicum*. Cloning of the gene and identification of gluatamate 324 at the active site" *Eur J Biochem*, 269:372-380.
Simpson, H.L. et al. (2014) "IBD: microbiota manipulation through diet and modified bacteria" *Dig Dis*, 32(Suppl 1):18-25.
Siuti, P. et al. (May 8, 2014) "Engineering genetic circuits that compute and remember" *Nature Protocols*, 9(6):1292-1300.
Smith, P.M. et al. (Aug. 2013) "The microbial metabolites, short-chain fatty acids, regulate colonic $T_{reg}$ cell homeostasis" *Science*, 341(6145):569-573.
Sonnenborn and Schulze (2009) "The non-pathogenic *Escherichia coli* strain Nissle 1917—features of a versatile probiotic" *Microbial Ecology in Health and Disease*, 21:122-158.
Spiro, S. (2006) "Nitric oxide-sensing mechanisms in *Escherichia coli*" *Biochem Soc Trans*, 34(1):200-202
Stanley, S.A. et al. (Oct. 2003) "Acute infection and macrophage subversion by *Mycobacterium tuberculosis* require a specialized secretion system" *PNAS*, 100(22):13001-13006.
Steidler, L. et al. (Jul. 1, 2003) "Biological containment of genetically modified *Lactococcus lactis* for intestinal delivery of human interleukin 10" *Nat Biotechnol*, 21:785-789.
Tseng, H-C. and K.L.J. Prather (Oct. 2012) "Controlled biosynthesis of odd-chain fuels and chemicals via engineered modular metabolic pathways" *PNAS*, 109(44):17925-17980, with Supporting Information (11 pages).
Ukena et al. (Dec. 12, 2007) "Probiotic *Escherichia coli* Nissle 1917 inhibits leaky gut by enhancing mucosal integrity" *PLoS One*, 2(12):e1308. [online] DOI: 10.1371/journal.pone.0001308 (11 pages).
Van Der Meer, J.R. and S. Belkin (Jul. 2010) "Where microbiology meets microengineering: design and applications of reporter bacteria" *Nat Rev Microbiol*, 8(7):511-522.
Vine, C.E. and J.A. Cole (2011) "Unresolved sources, sinks, and pathways for the recovery of enteric bacteria from nitrosative stress" *FEMS Microbiol Lett*, 325:99-107.
Wen, L. et al. (Oct. 2008) "Innate immunity and intestinal microbiota in the development of Type 1 diabetes" *Nature*, 455(7216):1109-1113. HHS Public Access Author Manuscript; available in PMC Apr. 23, 2009 (13 pages).
Wright et al. (Mar. 20, 2015) "GeneGuard: A modular plasmid system designed for biosafety" *ACS Synth Biol*, 4(3):307-316.
Xiao, B. et al. (May 2014) "Nanoparticles with surface antibody against CD98 and carrying CD98 small interfering RNA reduce colitis in mice" *Gastroenterology*, 146(5):1289-1300. NIH Public Access Author Manuscript; available in PMC May 1, 2015 (27 pages).
Yazbeck, R. et al. (Apr. 2009) "Growth factor based therapies and intestinal disease: is glucagon-like peptide-2 the new way forward?" *Cytokine Growth Factor Rev*, 20(2):175-184.
Zhang and Lin (2009) "DEG 5.0, a database of essential genes in both prokaryotes and eukaryotes" *Nucl Acids Res*, 37(suppl. 1):D455-D458.
U.S. Appl. No. 62/263,329, filed Dec. 4, 2015, by Kotula et al.
U.S. Appl. No. 62/183,935, filed Jun. 24, 2015, by Kotula et al.
U.S. Appl. No. 62/277,654, filed Jan. 12, 2016, by Kotula et al.

(56) References Cited

OTHER PUBLICATIONS

U.S. Appl. No. 15/164,828, filed May 25, 2016, by Falb et al.
U.S. Appl. No. 15/301,230, filed Sep. 30, 2016, by Falb et al.
Aujla et al. (2009) "IL-22: A critical mediator in mucosal host defense." *J Mol Med* 87, 451-454. https://doi.org/10.1007/s00109-009-0448-1.
Martin et al. (2014) "Effects in the use of a genetically engineered strain of Lactococcus lactis delivering in situ IL-10 as a therapy to treat low-grade colon inflammation" *Human Vaccines & Immunotherapeutics*, 10:6, 1611-1621, DOI: 10.4161/hv.28549.
Pickert et al. (Jul. 2009) "STAT3 links IL-22 signaling in intestinal epithelial cells to mucosal wound healing." *J Exp Med*; 206 (7): 1465-1472.
Steidler et al. (Jul. 1, 2003) "Biological containment of genetically modified *Lactococcus lactis* for intestinal delivery of human interleukin 10" *Nat Biotechnol*, 21:785-789.
Sugimoto et al. (Jan. 2008) "IL-22 ameliorates intestinal inflammation in a mouse model of ulcerative colitis" *J Clin Invest.* ;118(2):534-544. https://doi.org/10.1172/JCI33194.
Tominaga, et al. (2013) "Autonomous cure of damaged human intestinal epithelial cells by TLR2 and TLR4-dependent production of IL-22 in response to Spirulina polysaccharides" *International Immunopharmacology*, vol. 17, Issue 4, pp. 1009-1019.
Bialek et al. (1986) "Isolation and Partial Characterization of the Major Amide-Linked Conjugate of Indole-3-Acetic Acid from Phaseolus vulgaris L." *Plant Physiol.* 80: 99-104.
Daniel et al. (2011) "Recombinant lactic acid bacteria as mucosal biotherapeutic agents" *Trends in Biotechnol.* 29(10):499-508.
Jensen et al. (1995) "3-Methylindole (skatole) and indole production by mixed populations of pig fecal bacteria" *Applied and Environmental Microbiology* 61(8):3180-3184.
Kochar et al. (2011) "Indole-3-acetic acid biosynthesis in the biocontrol strain Pseudomonas fluorescens Psd and plant growth regulation by hormone overexpression" *Res Microbiol* 162: 426-435.
Nasr et al. (2014) Construction of a Synthetically Engineered nirB Promoter for Expression of Recombinant Protein in *Escherichia coli Jundishapur Journal of Microbiology*, 7(7):e15942 (pp. 1-5).
Staswick et al. (2005) "Characterization of an *Arabidopsis* Enzyme Family That Conjugates Amino Acids to Indole-3-Acetic Acid" The Plant Cell 17: 616-627.
Tsavkelova et al. (2006) "Microbial producers of plant growth stimulators and their practical use: A review" *Applied Biochem. and Microbial.* 42(2): 117-126.
Yoshikawa et al. (2004) "Reactive oxygens species, nitric oxide, and carbon monoxide in inflammatory bowel disease" *Inflammation and Regeneration*, 24(5):545-552 (JP Article).
Biddlestone et al. (2015) "The role of hypoxia in inflammatory disease (review)" *Int J Mol Med* 35(4): 859-869.
Cook et al. (1998) Short chain fatty acids in health and disease. *Aliment Pharmacol Ther* 12: 499-507.
Dubbs et al. (2012) "Peroxide-Sensing Transcriptional Regulators in Bacteria" *Journal of Bacteriology* 194( 20): 5495-5503 8 an d1998.
Hillman (1978) "Simple, Rapid Method for Determination of Propionic Acid and Other Short-Chain Fatty Acids in Serum" *Clinical Chemistry* 24(5): 800-803.
Li et al. (2004) "IL-10 and its related cytokines for treatment of inflammatory bowel disease" *World Journal of Gastroenterology*, 10(5): 620-625.
Liu, et al. "Construction of highly efficient *E. coli* expression systems containing low oxygen induced promoter and partition region." Applied microbiology and biotechnology 68.3 (2005): 346-354. Dec. 2, 2005 (IL).
Loeria-Arias et al. (2014) "Secretion of biologically active human interleukin 22 (IL-22) by Lactococcus lactis" *Biotechnology Letters*, 36:2489-2494.
Motta et al. (2012) "Food-Grade bacteria expressing Elafin protect against inflammation and restore colon homeostasis." *Sci. Transl. Med.* 4(158): 158ra144.

Rui, Xing (2007) Recombination of Expression of Human Trefoil Family Factor 2 (TFF2) in Lactococcus Lactis and Its Protective Effects on Gut Injury, Chinese Doctoral Dissertations & Master's Theses Full-text Database (Doctor) Medicine and Health Sciences, p. E064-3.
Xing et al., "Recombination of Expression of Human Trefoil Family Factor 2 (TFF2) in Lactococcus Lactis and Its Protective Effects on Gut Injury" Doctoral Dissertations & Master's Theses Full-text Database (Doctor) Medicine and Health Sciences, p. E064-3, Jan. 15, 2007. <http://120.209.85.3:8091/KCMS/detail/detail.aspx?filename=2006177126.nh&dbcode=CDFD&dbname=CDFD2007>.
Akawi, L. et al. (2015) "Engineering *Escherichia coli* for high-level production of propionate" *J Ind Microbiol Biotechnol*, 42:1057-1072.
Baek, J-M. et al. (2013) "Butyrate Production in Engineered *Escherichia coli* With Synthetic Scaffolds" *Biotechnol Bioeng*, 110:2790-2794.
Bansal, T. et al. (Jan. 2010) "The bacterial signal indole increases epithelial-cell tight-junction resistance and attenuates indicators of inflammation" *PNAS*, 107(1):228-233.
Becker, S. et al. (Aug. 1996) "$O_2$ as the Regulatory Signal for FNR-Dependent Gene Regulation in *Escherichia coli*" *J Bacteriol*, 178(15):4515-4521.
Braat, H. et al. (2006) "A Phase I Trial With Transgenic Bacteria Expressing Interleukin-10 in Crohn's Disease" *Clin Gastroenterol Hepatol*, 4:754-759.
Duan, F. and J.C. March (Sep. 2008) "Interrupting *Vibrio cholerae* Infection of Human Epithelial Cells With Engineered Commensal Bacterial Signaling" *Biotechnol Bioeng*, 101:128-134.
Duan, F. et al. (Dec. 2008) "Secretion of Insulinotropic Proteins by Commensal Bacteria: Rewiring the Gut To Treat Diabetes" *Applied and Environmental Microbiology*, 74(23):7437-7438.
Gardlik, R. et al. (2012) "Recombinant Probiotic Therapy in Experimental Colitis in Mice" *Folia Biological (Praha)*, 58:238-245.
Huibregtse, I.L. et al. (2012) "Genetically Modified *Lactococcus lactis* for Delivery of Human Interieukin-10 to Dendritic Cells" *Gastroenterol Res Pract*, vol. 2012, Article ID 639291 (7 pages).
International Patent Application No. PCT/US2016/050836, filed Sep. 8, 2016, by Falb, Dean: International Search Report and Written Opinion, dated Mar. 15, 2017.
Macia, L. et al. (Apr. 2015) "Metabolite-sensing receptors GPR43 and GPR109A facilitate dietary fibre-induced gut homeostasis through regulation of the inflammasome" *Nature Communications*, 6:6734, DOI: 10.1038.ncomms7734 (15 pages).
Mengesha, A. et al. (2006) "Development of a flexible and potent hypoxiainducible promoter for tumor-targeted gene expression in attenuated salmonella" *Cancer Biology & Therapy*, 5(9):1120-1128.
Piñero-Lambea, C. et al. (2015) "Engineered bacteria as therapeutic agents" *Curr Opin Biotechnol*, 35:94-102.
Pöhlmann, C. et al. (2013) "Improving health from the inside" *Bioengineered*, 4(3):172-179.
Rao, S. et al. (Aug. 2005) "Toward a live microbial microbicide for HIV: Commensal bacteria secreting an HIV fusion inhibitor peptide" *PNAS*, 102(34):11993-11998.
Romasi, E.F. and J. Lee (2013) "Development of Indole-3-Acetic Acid-Producing *Escherichia coli* by Functional Expression of IpdC, AspC, and Iad1" *J Microbiol Biotechnol*, 23(12):1726-1736.
Schumann, S. et al. (2012) "Dextran Sodium Sulfate-Induced Inflammation Alters the Expression of Proteins by Intestinal *Escherichia coli* Strains in a Gnotobiotic Mouse Model" *Appl Environ Microbiol*, 78(5):1513-1522.
Seo, E-j. et al. (2012) "Construction of recombinant *E. coli* Nissle 1917 (EcN) strains for the expression and secretion of defensins" *Intl J Med Microbiol*, 302:276-287.
Shen, T. et al. (2012) "Improved Production of Tryptophan in Genetically Engineered *Escherichia coli* with TktA and PpsA Overexpression" *J Biomed Biotechnol*, vol. 2012, Article ID 605219 (8 pages).
Sleator, R.D. and C. Hill (2009) "Rational Design of Improved Pharmabiotics" *J Biomed Biotechnol*, vol. 2009, Article ID 275287 (7 pages).
Strauch, K.L. et al. (Feb. 1985) "Oxygen Regulation in *Salmonella typhimurium*" *J Baceriol*, 161(2):673-680.

(56) References Cited

OTHER PUBLICATIONS

Thorburn, A.N. et al. (Jun. 2015) "Evidence that asthma is a developmental origin disease influenced by maternal diet and bacterial metabolites" *Nature Communications*, 6:7320, DOI: 10.1038/ncomms8320 (13 pages).

Unden, G. et al. (2002) "Control of FNR Function of *Escherichia coli* by $O_2$ and Reducing Conditions" *J Mol Microbiol Biotechnol*, 4(3):263-268.

Westendorf, A.M. et al. (2005) "Intestinal immunity of *Escherichia coli* NISSLE 1917: a safe carrier for therapeutic molecules" *FEMS Immunol Med Microbiol*, 43:373-384.

Whelan, R.A. et al. (Oct. 2014) "A Transgenic Probiotic Secreting a Parasite Immunomodulator for Site-Directed Treatment of Gut Inflammation" *Molecular Therapy*, 22(10):1730-1740.

U.S. Appl. No. 15/599,285, filed May 18, 2017, by Falb et al.

\* cited by examiner

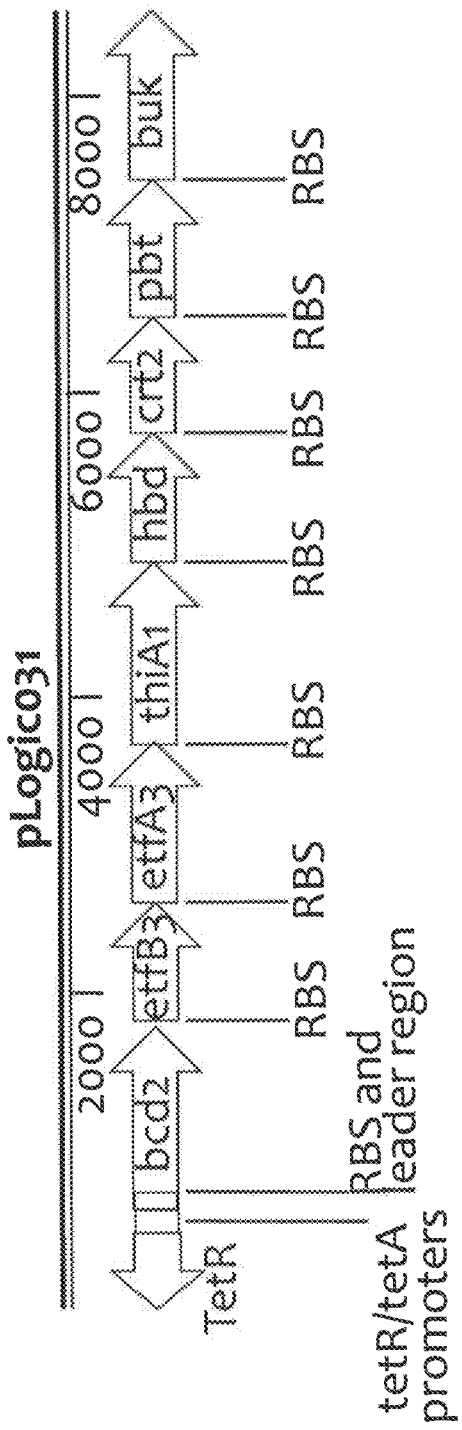
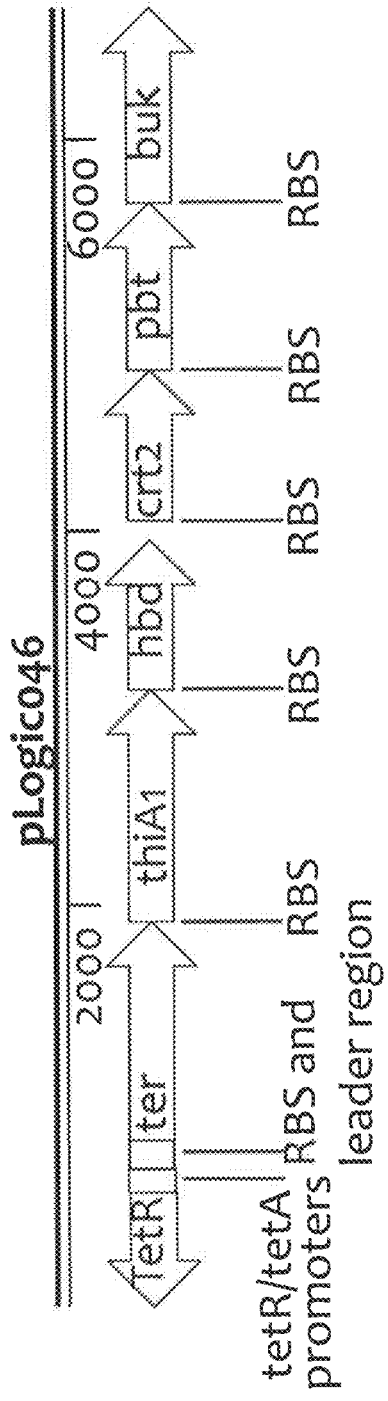

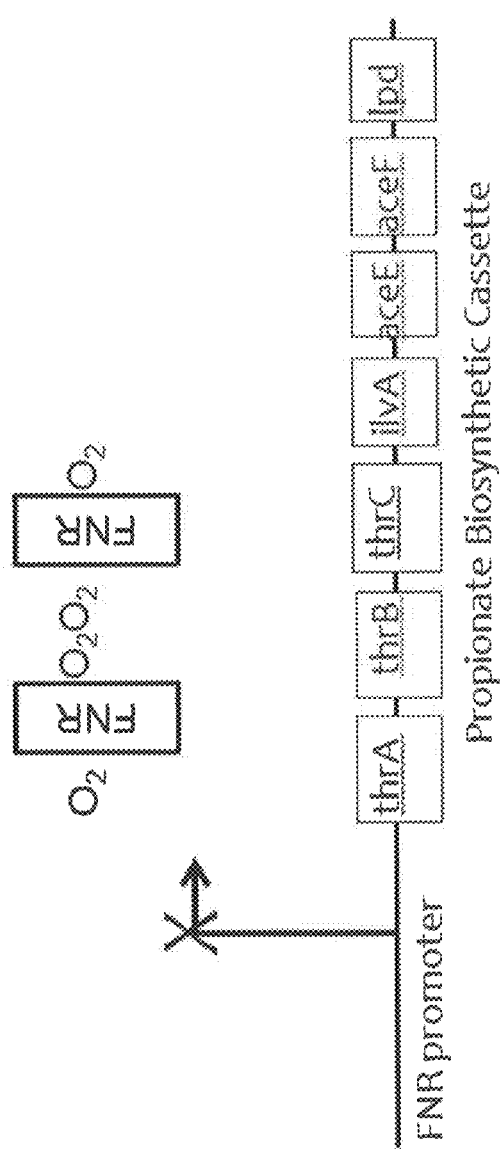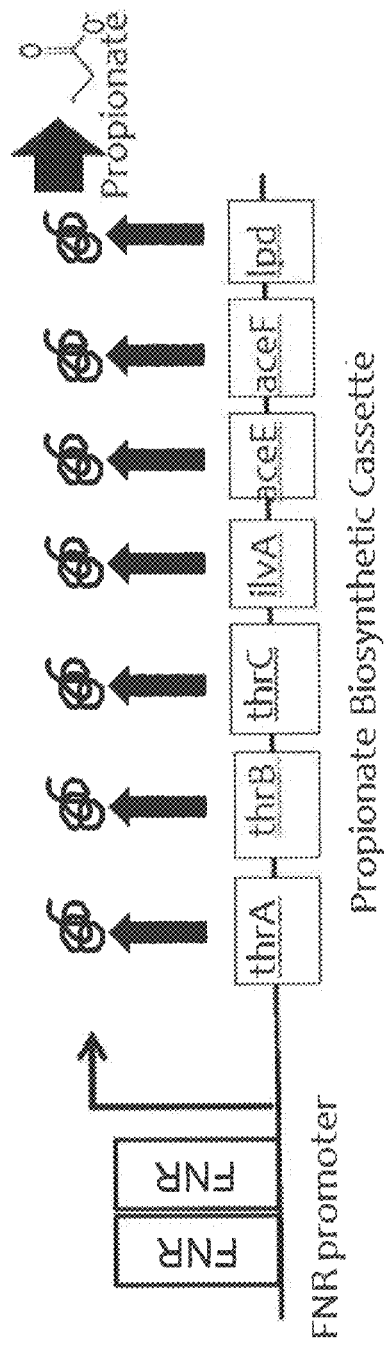

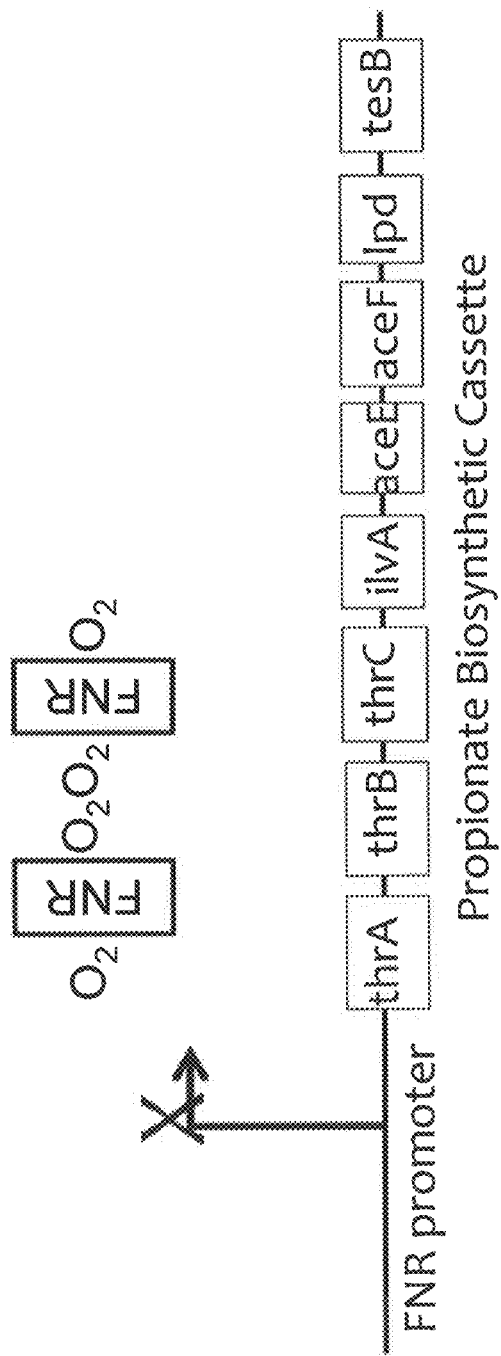
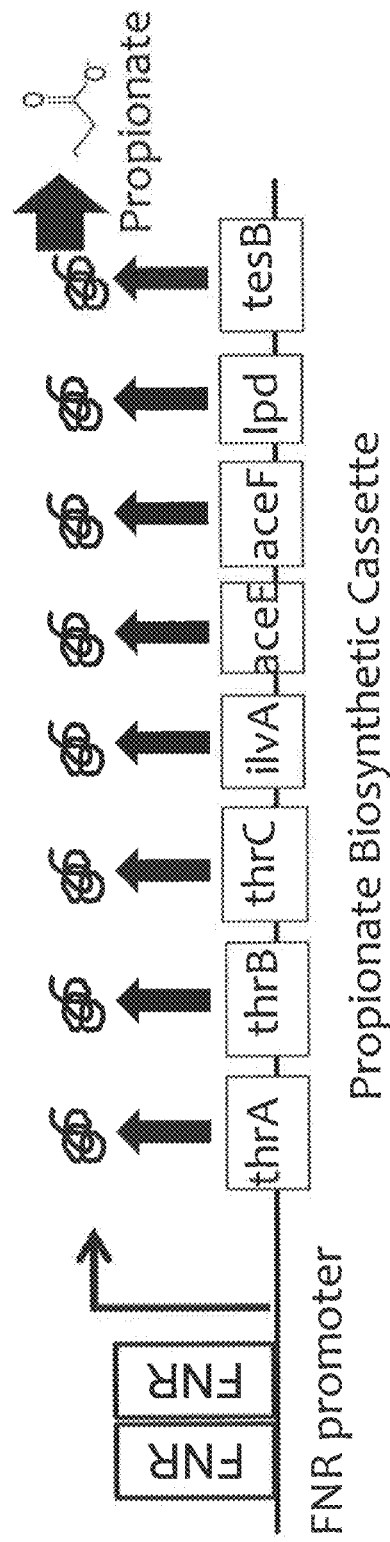
FIG. 9A
FIG. 9B

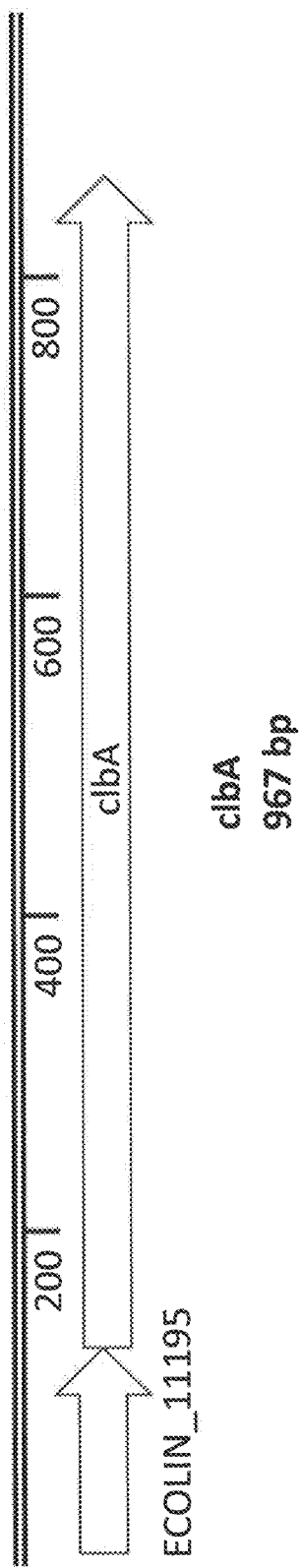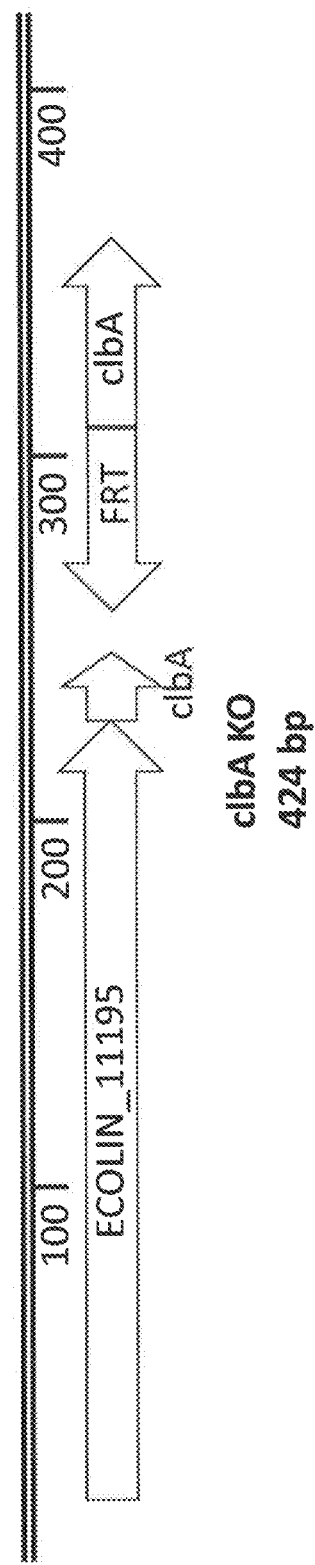

BACTERIA ENGINEERED TO TREAT DISEASES THAT BENEFIT FROM REDUCED GUT INFLAMMATION AND/OR TIGHTENED GUT MUCOSAL BARRIER

SEQUENCE LISTING

The instant application contains a Sequence Listing which has been submitted electronically in ASCII format and is hereby incorporated by reference in its entirety. Said ASCII copy, created on Nov. 10, 2016, is named 12671_0008-01000_SL.txt and is 812,550 bytes in size.

This disclosure relates to compositions and therapeutic methods for inhibiting inflammatory mechanisms in the gut, restoring and tightening gut mucosal barrier function, and/or treating and preventing autoimmune disorders. In certain aspects, the disclosure relates to genetically engineered bacteria that are capable of reducing inflammation in the gut and/or enhancing gut barrier function. In some embodiments, the genetically engineered bacteria are capable of reducing gut inflammation and/or enhancing gut barrier function, thereby ameliorating or preventing an autoimmune disorder. In some aspects, the compositions and methods disclosed herein may be used for treating or preventing autoimmune disorders as well as diseases and conditions associated with gut inflammation and/or compromised gut barrier function, e.g., diarrheal diseases, inflammatory bowel diseases, and related diseases.

Inflammatory bowel diseases (IBDs) are a group of diseases characterized by significant local inflammation in the gastrointestinal tract typically driven by T cells and activated macrophages and by compromised function of the epithelial barrier that separates the luminal contents of the gut from the host circulatory system (Ghishan et al., 2014). IBD pathogenesis is linked to both genetic and environmental factors and may be caused by altered interactions between gut microbes and the intestinal immune system. Current approaches to treat IBD are focused on therapeutics that modulate the immune system and suppress inflammation. These therapies include steroids, such as prednisone, and tumor necrosis factor (TNF) inhibitors, such as Humira® (Cohen et al., 2014). Drawbacks from this approach are associated with systemic immunosuppression, which includes greater susceptibility to infectious disease and cancer.

Other approaches have focused on treating compromised barrier function by supplying the short-chain fatty acid butyrate via enemas. Recently, several groups have demonstrated the importance of short-chain fatty acid production by commensal bacteria in regulating the immune system in the gut (Smith et al., 2013), showing that butyrate plays a direct role in inducing the differentiation of regulatory T cells and suppressing immune responses associated with inflammation in IBD (Atarashi et al., 2011; Furusawa et al., 2013). Butyrate is normally produced by microbial fermentation of dietary fiber and plays a central role in maintaining colonic epithelial cell homeostasis and barrier function (Hamer et al., 2008). Studies with butyrate enemas have shown some benefit to patients, but this treatment is not practical for long term therapy. More recently, patients with IBD have been treated with fecal transfer from healthy patients with some success (Ianiro et al., 2014). This success illustrates the central role that gut microbes play in disease pathology and suggests that certain microbial functions are associated with ameliorating the IBD disease process. However, this approach raises safety concerns over the transmission of infectious disease from the donor to the recipient. Moreover, the nature of this treatment has a negative stigma and thus is unlikely to be widely accepted.

Compromised gut barrier function also plays a central role in autoimmune diseases pathogenesis (Lerner et al., 2015a; Lerner et al., 2015b; Fasano et al., 2005; Fasano, 2012). A single layer of epithelial cells separates the gut lumen from the immune cells in the body. The epithelium is regulated by intercellular tight junctions and controls the equilibrium between tolerance and immunity to nonself-antigens (Fasano et al., 2005). Disrupting the epithelial layer can lead to pathological exposure of the highly immunoreactive subepithelium to the vast number of foreign antigens in the lumen (Lerner et al., 2015a) resulting in increased susceptibility to and both intestinal and extraintestinal autoimmune disorders can occur" (Fasano et al., 2005). Some foreign antigens are postulated to resemble self-antigens and can induce epitope-specific cross-reactivity that accelerates the progression of a pre-existing autoimmune disease or initiates an autoimmune disease (Fasano, 2012). Rheumatoid arthritis and celiac disease, for example, are autoimmune disorders that are thought to involve increased intestinal permeability (Lerner et al., 2015b). In individuals who are genetically susceptible to autoimmune disorders, dysregulation of intercellular tight junctions can lead to disease onset (Fasano, 2012). In fact, the loss of protective function of mucosal barriers that interact with the environment is necessary for autoimmunity to develop (Lerner et al., 2015a).

Changes in gut microbes can alter the host immune response (Paun et al., 2015; Sanz et al., 2014; Sanz et al., 2015; Wen et al., 2008). For example, in children with high genetic risk for type 1 diabetes, there are significant differences in the gut microbiome between children who develop autoimmunity for the disease and those who remain healthy (Richardson et al., 2015). Others have shown that gut bacteria are a potential therapeutic target in the prevention of asthma and exhibit strong immunomodulatory capacity . . . in lung inflammation (Arrieta et al., 2015). Thus, enhancing barrier function and reducing inflammation in the gastrointestinal tract are potential therapeutic mechanisms for the treatment or prevention of autoimmune disorders.

Recently there has been an effort to engineer microbes that produce anti-inflammatory molecules, such as IL-10, and administer them orally to a patient in order to deliver the therapeutic directly to the site of inflammation in the gut. The advantage of this approach is that it avoids systemic administration of immunosuppressive drugs and delivers the therapeutic directly to the gastrointestinal tract. However, while these engineered microbes have shown efficacy in some pre-clinical models, efficacy in patients has not been observed. One reason for the lack of success in treating patients is that the viability and stability of the microbes are compromised due to the constitutive production of large amounts of non-native proteins, e.g., human interleukin. Thus, there remains a great need for additional therapies to reduce gut inflammation, enhance gut barrier function, and/or treat autoimmune disorders, and that avoid undesirable side effects.

SUMMARY

The genetically engineered bacteria disclosed herein are capable of producing therapeutic anti-inflammation and/or gut barrier enhancer molecules. In some embodiments, the genetically engineered bacteria are functionally silent until they reach an inducing environment, e.g., a mammalian gut, wherein expression of the therapeutic molecule is induced. In certain embodiments, the genetically engineered bacteria are naturally non-pathogenic and may be introduced into the gut in order to reduce gut inflammation and/or enhance gut barrier function and may thereby further ameliorate or prevent an autoimmune disorder. In certain embodiments, the anti-inflammation and/or gut barrier enhancer molecule is stably produced by the genetically engineered bacteria, and/or the genetically engineered bacteria are stably maintained in vivo and/or in vitro. The invention also provides pharmaceutical compositions comprising the genetically engineered bacteria, and methods of treating diseases that benefit from reduced gut inflammation and/or tightened gut mucosal barrier function, e.g., an inflammatory bowel disease or an autoimmune disorder.

In some embodiments, the genetically engineered bacteria of the invention produce one or more therapeutic molecule(s) under the control of one or more promoters induced by an environmental condition, e.g., an environmental condition found in the mammalian gut, such as an inflammatory condition or a low oxygen condition. Thus, in some embodiments, the genetically engineered bacteria of the invention produce one or more therapeutic molecule(s) under the control of an oxygen level-dependent promoter, a reactive oxygen species (ROS)-dependent promoter, or a reactive nitrogen species (RNS)-dependent promoter, and a corresponding transcription factor. In some embodiments, the therapeutic molecule is butyrate; in an inducing environment, the butyrate biosynthetic gene cassette is activated, and butyrate is produced. Local production of butyrate induces the differentiation of regulatory T cells in the gut and/or promotes the barrier function of colonic epithelial cells. The genetically engineered bacteria of the invention produce their therapeutic effect only in inducing environments such as the gut, thereby lowering the safety issues associated with systemic exposure.

BRIEF DESCRIPTION OF THE FIGURES

FIG. 2A, FIG. 2B, FIG. 2C, and FIG. 2D depict schematics of a butyrate production pathway and schematics of different butyrate producing circuits. FIG. 2A depicts a metabolic pathway for butyrate production. FIG. 2B and FIG. 2C depict schematics of two different exemplary butyrate producing circuits, both under the control of a tetracycline inducible promoter. FIG. 2B depicts a bdc2 butyrate cassette under control of tet promoter on a plasmid. A "bdc2 cassette" or "bdc2 butyrate cassette" refres to a butyrate producing cassette that comprises at least the following genes: bcd2, etfB3, etfA3, hbd, crt2, pbt, and buk genes. FIG. 2C depicts a ter butyrate cassette (ter gene replaces the bcd2, etfB3, and etfA3 genes) under control of tet promoter on a plasmid. A "ter cassette" or "ter butyrate cassette" refers to a butyrate producing cassette that comprises at least the following genes: ter, thiA1, hbd, crt2, pbt, buk. FIG. 2D depicts a schematic of a third exemplary butyrate gene cassette under the control of a tetracycline inducible promoter, specifically, a tesB butyrate cassette (ter gene is present and tesB gene replaces the pbt gene and the buk gene) under control of tet promoter on a plasmid. A "tes or tesB cassette or "tes or tesB butyrate cassette" refers to a butyrate producing cassette that comprises at least ter, thiA1, hbd, crt2, and tesB genes. An alternative butyrate cassette of the disclosure comprises at least bcd2, etfB3, etfA3, thiA1, hbd, crt2, and tesB genes. In some embodiments, the tes or tesB cassette is under control of an inducible promoter other than tetracycline. Exemplary inducible promoters which may control the expression of the tesB cassette include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline.

FIG. 3A and FIG. 3B depict the gene organization of an exemplary engineered bacterium of the invention and its induction of butyrate production under low-oxygen conditions. FIG. 3A depicts relatively low butyrate production under aerobic conditions in which oxygen ($O_2$) prevents (indicated by "X") FNR (boxed "FNR") from dimerizing and activating the FNR-responsive promoter ("FNR promoter"). Therefore, none of the butyrate biosynthesis enzymes (bcd2, etfB3, etfA3, thiA1, hbd, crt2, pbt, and buk; white boxes) is expressed. FIG. 3B depicts increased butyrate production under low-oxygen or anaerobic conditions due to FNR dimerizing (two boxed "FNR" s), binding to the FNR-responsive promoter, and inducing expression of the butyrate biosynthesis enzymes, which leads to the production of butyrate. FIG. 3C and FIG. 3D depict the gene organization of an exemplary recombinant bacterium of the invention and its derepression in the presence of nitric oxide (NO). In FIG. 3C, in the absence of NO, the NsrR transcription factor (circle, "NsrR") binds to and represses a corresponding regulatory region. Therefore, none of the butyrate biosynthesis enzymes (bcd2, etfB3, etfA3, thiA1, hbd, crt2, pbt, buk) is expressed. In FIG. 3D, in the presence of NO, the NsrR transcription factor interacts with NO, and no longer binds to or represses the regulatory sequence. This leads to expression of the butyrate biosynthesis enzymes (indicated by black arrows and black squiggles) and ultimately to the production of butyrate.

FIG. 3E and FIG. 3F depict the gene organization of an exemplary recombinant bacterium of the invention and its induction in the presence of H2O2. In FIG. 3E, in the absence of H2O2, the OxyR transcription factor (circle, "OxyR") binds to, but does not induce, the oxyS promoter. Therefore, none of the butyrate biosynthesis enzymes (bcd2, etfB3, etfA3, thiA1, hbd, crt2, pbt, buk) is expressed. In FIG. 3F, in the presence of H2O2, the OxyR transcription factor interacts with H2O2 and is then capable of inducing the oxyS promoter. This leads to expression of the butyrate biosynthesis enzymes (indicated by black arrows and black squiggles) and ultimately to the production of butyrate.

FIG. 4A and FIG. 4B depict the gene organization of another exemplary engineered bacterium of the invention and its induction of butyrate production under low-oxygen conditions using a different butyrate circuit from that shown in FIG. 3. FIG. 4A depicts relatively low butyrate production under aerobic conditions in which oxygen ($O_2$) prevents (indicated by "X") FNR (boxed "FNR") from dimerizing and activating the FNR-responsive promoter ("FNR promoter"). Therefore, none of the butyrate biosynthesis enzymes (ter, thiA1, hbd, crt2, pbt, and buk; white boxes) is expressed. FIG. 4B depicts increased butyrate production under low-oxygen or anaerobic conditions due to FNR dimerizing (two boxed "FNR" s), binding to the FNR-responsive promoter, and inducing expression of the butyrate biosynthesis enzymes, which leads to the production of butyrate. FIG. 4C and FIG. 4D depict the gene organization of another exemplary recombinant bacterium of the invention and its derepression in the presence of NO. In FIG. 4C, in the absence of NO, the NsrR transcription factor (circle, "NsrR") binds to and represses a corresponding regulatory region. Therefore, none of the butyrate biosynthesis enzymes (ter, thiA1, hbd, crt2, pbt, buk) is expressed. In FIG. 4D, in the presence of NO, the NsrR transcription factor interacts with NO, and no longer binds to or represses the regulatory sequence. This leads to expression of the butyrate biosynthesis enzymes (indicated by black arrows and black squiggles) and ultimately to the production of butyrate. FIG. 4E and FIG. 4F depict the gene organization of another exemplary recombinant bacterium of the invention and its induction in the presence of $H_2O_2$. In FIG. 4E, in the absence of $H_2O_2$, the OxyR transcription factor (circle, "OxyR") binds to, but does not induce, the oxyS promoter. Therefore, none of the butyrate biosynthesis enzymes (ter, thiA1, hbd, crt2, pbt, buk) is expressed. In FIG. 4F, in the presence of $H_2O_2$, the OxyR transcription factor interacts with $H_2O_2$ and is then capable of inducing the oxyS promoter. This leads to expression of the butyrate biosynthesis enzymes (indicated by black arrows and black squiggles) and ultimately to the production of butyrate.

FIG. 5A and FIG. 5B depict the gene organization of an exemplary recombinant bacterium of the invention and its induction under low-oxygen conditions. FIG. 5A depicts relatively low butyrate production under aerobic conditions in which oxygen ($O_2$) prevents (indicated by "X") FNR (boxed "FNR") from dimerizing and activating the FNR-responsive promoter ("FNR promoter"). Therefore, none of the butyrate biosynthesis enzymes (ter, thiA1, hbd, crt2, and tesB) is expressed. FIG. 5B depicts increased butyrate production under low-oxygen conditions due to FNR dimerizing (two boxed "FNR" s), binding to the FNR-responsive promoter, and inducing expression of the butyrate biosynthesis enzymes, which leads to the production of butyrate. FIG. 5C and FIG. 5D depict the gene organization of another exemplary recombinant bacterium of the invention and its derepression in the presence of NO. In FIG. 5C, in the absence of NO, the NsrR transcription factor ("NsrR") binds to and represses a corresponding regulatory region. Therefore, none of the butyrate biosynthesis enzymes (ter, thiA1, hbd, crt2, tesB) is expressed. In FIG. 5D, in the presence of NO, the NsrR transcription factor interacts with NO, and no longer binds to or represses the regulatory sequence. This leads to expression of the butyrate biosynthesis enzymes (indicated by black arrows and black squiggles) and ultimately to the production of butyrate. FIG. 5E and FIG. 5F depict the gene organization of another exemplary recombinant bacterium of the invention and its induction in the presence of $H_2O_2$. In FIG. 5E, in the absence of $H_2O_2$, the OxyR transcription factor (circle, "OxyR") binds to, but does not induce, the oxyS promoter. Therefore, none of the butyrate biosynthesis enzymes (ter, thiA1, hbd, crt2, tesB) is expressed. In FIG. 6F, in the presence of $H_2O_2$, the OxyR transcription factor interacts with $H_2O_2$ and is then capable of inducing the oxyS promoter. This leads to expression of the butyrate biosynthesis enzymes (indicated by black arrows and black squiggles) and ultimately to the production of butyrate.

FIG. 6A depicts relatively low propionate production under aerobic conditions in which oxygen ($O_2$) prevents (indicated by "X") FNR (boxed "FNR") from dimerizing and activating the FNR-responsive promoter ("FNR promoter"). Therefore, none of the propionate biosynthesis enzymes (pct, lcdA, lcdB, lcdC, etfA, acrB, acrC) is expressed. FIG. 6B depicts increased propionate production under low-oxygen or anaerobic conditions due to FNR dimerizing (two boxed "FNR" s), binding to the FNR-responsive promoter, and inducing expression of the propionate biosynthesis enzymes, which leads to the production of propionate. In other embodiments, propionate production is induced by NO or $H_2O_2$ as depicted and described for the butyrate cassette(s) in the preceding FIG. 3C-3F, FIG. 4C-4F, FIG. 5C-5F.

FIG. 8A, FIG. 8B, and FIG. 8C depict schematics of the gene organization of exemplary bacteria of the disclosure for inducible propionate production. FIG. 8A depicts relatively low propionate production under aerobic conditions in which oxygen ($O_2$) prevents (indicated by "X") FNR (boxed "FNR") from dimerizing and activating the FNR-responsive promoter ("FNR promoter"). Therefore, none of the propionate biosynthesis enzymes (thrA, thrB, thrC, ilvA, aceE, aceF, lpd) is expressed. FIG. 8B depicts increased propionate production under low-oxygen or anaerobic conditions due to FNR dimerizing (two boxed "FNR"s), binding to the FNR-responsive promoter, and inducing expression of the propionate biosynthesis enzymes, which leads to the production of propionate. FIG. 8C depicts an exemplary propionate biosynthesis gene cassette. In other embodiments, propionate production is induced by NO or $H_2O_2$ as depicted and described for the butyrate cassette(s) in the preceding FIG. 3C-3F, FIG. 4C-4F, FIG. 5C-5F.

FIG. 9A and FIG. 9B depict schematics of the gene organization of exemplary bacteria of the disclosure for inducible propionate production. FIG. 9A depicts relatively low propionate production under aerobic conditions in which oxygen ($O_2$) prevents (indicated by "X") FNR (boxed "FNR") from dimerizing and activating the FNR-responsive promoter ("FNR promoter"). Therefore, none of the propionate biosynthesis enzymes (thrA, thrB, thrC, ilvA, aceE, aceF, lpd, tesB) is expressed. FIG. 9B depicts increased propionate production under low-oxygen or anaerobic conditions due to FNR dimerizing (two boxed "FNR" s), binding to the FNR-responsive promoter, and inducing expression of the propionate biosynthesis enzymes, which leads to the production of propionate. In other embodiments, propionate production is induced by NO or $H_2O_2$ as depicted and described for the butyrate cassette(s) in the preceding FIG. 3C-3F, FIG. 4C-4F, FIG. 5C-5F.

FIG. 10A depicts a schematic of a genetically engineered sleeping beauty metabolic pathway from *E. coli* for propionate production. The SBM pathway is cyclical and composed of a series of biochemical conversions forming propionate as a fermentative product while regenerating the starting molecule of succinyl-CoA. FIG. 10B and FIG. 10C depict schematics of the gene organization of another exemplary engineered bacterium of the invention and its induction of propionate production under low-oxygen conditions. FIG. 10B depicts relatively low propionate production under aerobic conditions in which oxygen ($O_2$) prevents (indicated by "X") FNR (boxed "FNR") from dimerizing and activating the FNR-responsive promoter ("FNR promoter"). Therefore, none of the propionate biosynthesis enzymes (sbm, ygfD, ygfG, ygfH) is expressed. FIG. 10C depicts increased propionate production under low-oxygen or anaerobic conditions due to FNR dimerizing (two boxed "FNR" s), binding to the FNR-responsive promoter, and inducing expression of the propionate biosynthesis enzymes, which leads to the production of propionate. In other embodiments, propionate production is induced by NO or $H_2O_2$ as depicted and described for the butyrate cassette(s) in the preceding FIG. 3C-3F, FIG. 4C-4F, FIG. 5C-5F.

FIG. 11 shows butyrate production in strains pLOGIC031 and pLOGIC046 in the presence and absence of oxygen, in which there is no significant difference in butyrate production. Enhanced butyrate production was shown in Nissle in low copy plasmid expressing pLOGIC046 which contain a deletion of the final two genes (ptb-buk) and their replacement with the endogenous *E. Coli* tesB gene (a thioesterase that cleaves off the butyrate portion from butyryl CoA). Overnight cultures of cells were diluted 1:100 in Lb and grown for 1.5 hours until early log phase was reached at which point anhydrous tet was added at a final concentration of 100 ng/ml to induce plasmid expression. After 2 hours induction, cells were washed and resuspended in M9 minimal media containing 0.5% glucose at OD600=0.5. Samples were removed at indicated times and cells spun down. The supernatant was tested for butyrate production using LC-MS.

FIG. 12 shows butyrate production in strains comprising a tet-butyrate cassette having ter substitution (pLOGIC046) or the tesB substitution (ptb-buk deletion), demonstrating that the tesB substituted strain has greater butyrate production.

FIG. 14A depicts a schematic showing a butyrate producing circuit under the control of an FNR promoter. FIG. 14B depicts a bar graph of anaerobic induction of butyrate production. FNR-responsive promoters were fused to butyrate cassettes containing either the bcd or ter circuits. Transformed cells were grown in LB to early log and placed in anaerobic chamber for 4 hours to induce expression of butyrate genes. Cells were washed and resuspended in minimal media w/0.5% glucose and incubated microaerobically to monitor butyrate production over time. SYN-501 led to significant butyrate production under anaerobic conditions. FIG. 14C depicts SYN-501 in the presence and absence of glucose and oxygen in vitro. SYN-501 comprises pSC101 PydfZ-ter butyrate plasmid; SYN-500 comprises pSC101 PydfZ-bcd butyrate plasmid; SYN-506 comprises pSC101 nirB-bcd butyrate plasmid. FIG. 14D depict levels of mouse lipocalin 2 (left) and calprotectin (right) quantified by ELISA using the fecal samples in an in vivo model. SYN-501 reduces inflammation and/or protects gut barrier function as compared to wild type Nissle control.

FIG. 20A depicts the construction and gene organization of an exemplary plasmids comprising a gene encoding NsrR, a regulatory sequence from norB, and a butyrogenic gene cassette (pLogic031-nsrR-norB-butyrate construct). FIG. 20B depicts the construction and gene organization of another exemplary plasmid comprising a gene encoding NsrR, a regulatory sequence from norB, and a butyrogenic gene cassette (pLogic046-nsrR-norB-butyrogenic gene cassette).

FIG. 32A depicts a schematic of a human GLP2 construct inserted into the FliC locus, under the control of the native FliC promoter. FIG. 32B depicts a schematic of a human GLP2 construct, including the N terminal 20 amino acids of FliC, inserted into the FliC locus under the control of the native FliC promoter. FIG. 32C depicts a schematic of a human GLP2 construct, including the N-terminal 20 amino acids of FliC, inserted into the FliC locus under the control of a tet inducible promoter. FIG. 32D depicts a schematic of a human GLP2 construct with a N terminal OmpF secretion tag (sec-dependent secretion system) under the control of a tet inducible promoter. FIG. 32E depicts a schematic of a human GLP2 construct with a N terminal TorA secretion tag (tat secretion system) under the control of a tet inducible promoter.

FIG. 33A depicts a line graph, showing an phopho-STAT3 (Tyr705) ELISA conducted on extracts from serum-starved Colo205 cells treated with supernatants from engineered bacteria comprising a PAL deletion and an integrated construct encoding hIL-22 with a phoA secretion tag. The data demonstrate that hIL-22 secreted from the engineered bacteria is functionally active. FIG. 33B depicts a line graph, showing an phopho-STAT3 (Tyr705) ELISA showing a antibody completion assay. Extracts from Colo205 cells were treated with the bacterial supernatants from the IL-22 overexpressing strain preincubated with increasing concentrations of neutralizing anti-IL-22 antibody. The data demonstrated that phospho-Stat3 signal induced by the secreted hIL-22 is competed away by the hIL-22 antibody MAB7821.

FIG. 36A depicts a schematic of molecular mechanisms of action of indole and its metabolites on host physiology and disease. Tryptophan catabolized by bacteria to yield indole and other indole metabolites, e.g., Indole-3-propionate (IPA) and Indole-3-aldehyde (I3A), in the gut lumen. IPA acts on intestinal cells via pregnane X receptors (PXR) to maintain mucosal homeostasis and barrier function. I3A acts on the aryl hydrocarbon receptor (AhR) found on intestinal immune cells and promotes IL-22 production. Activation of AhR plays a crucial role in gut immunity, such as in maintaining the epithelial barrier function and promoting immune tolerance to promote microbial commensalism while protecting against pathogenic infections. Indole has a number of roles, such as a signaling molecule to intestinal L cells to produce glucagon-like protein 1 (GLP-1) or as a ligand for AhR (Zhang et al. Genome Med. 2016; 8: 46). FIG. 36B depicts a schematic of the trypophan catabolic pathway/indole biosynthesis pathways. Host and microbiota metabolites with AhR agonistic activity are in diamond and circled, respectively (see, e.g., Lamas et al., CARDS impacts colitis by altering gut microbiota metabolism of tryptophan into aryl hydrocarbon receptor ligands; Nature Medicine 22, 598-605 (2016). In certain embodiments of the disclosure, the genetically engineered bacteria comprise gene cassettes comprising one or more of the bacterial tryptophan metabolism enzymes which catalyze the reactions shown in FIGS. 36A and 36B. In certain embodiments, the genetically engineered bacteria comprise one or more gene cassettes which produce one or more of the metabolites depicted in FIGS. 36A and 36B, including but not limited to, kynurenine, indole-3-aldehyde, indole-3-acetic acid, and/or indole-3 acetaldehyde.

FIG. 37A depicts a schematic of the bacterial tryptophan metabolism, as described, e.g., in Enzymes are numbered as follows 1) Trp 2,3 dioxygenase (EC 1.13.11.11); 2) kynurenine formidase (EC 3.5.1.49); 3) kynureninase (EC 3.7.1.3); 4) tryptophanase (EC 4.1.99.1); 5) Trp aminotransferase (EC 2.6.1.27); 6) indole lactate dehydrogenase (EC1.1.1.110); 7) Trp decarboxylase (EC 4.1.1.28); 8) tryptamine oxidase (EC 1.4.3.4); 9) Trp side chain oxidase (EC 4.1.1.43); 10) indole acetaldehyde dehydrogenase (EC 1.2.1.3); 11) indole acetic acid oxidase; 13) Trp 2-monooxygenase (EC 1.13.12.3); and 14) indole acetamide hydrolase (EC 3.5.1.0). The dotted lines (---) indicate a spontaneous reaction. FIG. 37B Depicts a schematic of tryptophan derived pathways. Known AHR agonists are with asterisk. Abbreviations are as follows. Trp: Tryptophan; TrA: Tryptamine; IAAld: Indole-3-acetaldehyde; IAA: Indole-3-acetic acid; FICZ: 6-formylindolo(3,2-b)carbazole; IPyA: Indole-3-pyruvic acid; IAM: Indole-3-acetamine; IAOx: Indole-3-acetaldoxime; IAN: Indole-3-acetonitrile; N-formyl Kyn: N-formylkynurenine; Kyn: Kynurenine; KynA: Kynurenic acid; I3C: Indole-3-carbinol; IAld: Indole-3-aldehyde; DIM: 3,3'-Diindolylmethane; ICZ: Indolo(3,2-b)carbazole. Enzymes are numbered as follows: 1. EC 1.13.11.11 (Tdo2, Bna2), EC 1.13.11.11 (Ido1); 2. EC 4.1.1.28 (Tdc); 3. EC 1.4.3.22, EC 1.4.3.4 (TynA); 4. EC 1.2.1.3 (Iad1), EC 1.2.3.7 (Aaol); 5. EC 3.5.1.9 (Afmid Bna3); 6. EC 2.6.1.7 (Cclb1, Cclb2, Aadat, Got2); 7. EC 1.4.99.1 (TnaA); 8. EC 1.14.13.125 (CYP79B2, CYP79B3); 9. EC 1.4.3.2 (StaO), EC 2.6.1.27 (Aro9, aspC), EC 2.6.1.99 (Taal), EC 1.4.1.19 (TrpDH); 10. EC 1.13.12.3 (IaaM); 11. EC 4.1.1.74 (IpdC); 12. EC 1.14.13.168 (Yuc2); 13. EC 3.5.1.4 (IaaH); 14. EC 3.5.5.1. (Nit1); 15. EC 4.2.1.84 (Nit1); 16. EC 4.99.1.6 (CYP71A13); 17. EC 3.2.1.147 (Pen2). In certain embodiments of the disclosure, the genetically engineered bacteria comprise gene cassettes comprising one or more of the bacterial tryptophan metabolism enzymes depicted in FIGS. 37A and 37B. In certain embodiments, the genetically engineered bacteria comprise one or more gene cassettes which produce one or more of the metabolites depicted in FIGS. 37A and 37B. In certain embodiments, the one or more cassettes are on a plasmid; in other embodiments, the cassettes are integrated into the genome. In certain embodiments the one or more cassettes are under the control of inducible promoters which are induced under low-oxygen conditions, in the presence of certain molecules or metabolites, in the presence of molecules or metabolites associated with inflammation or an inflammatory response, or in the presence of some other metabolite that may or may not be present in the gut, such as arabinose.

FIG. 41A depicts one embodiment of the disclosure, in which the genetically engineered bacteria produce tryptamine from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit for Tryptophan decarboxylase, e.g., from *Catharanthus roseus*, which converts tryptophan to tryptamine, e.g., under the control of an inducible promoter e.g., an FNR promoter. FIG. 41B depicts one embodiment of the disclosure, in which the genetically engineered bacteria produce indole-3-acetaldehyde and FICZ from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit for aro9 (L-tryptophan aminotransferase, e.g., from *S. cerevisae*) or aspC (aspartate aminotransferase, e.g., from *E. coli*, or taa1 (L-tryptophan-pyruvate aminotransferase, e.g., from *Arabidopsis thaliana*) or staO (L-tryptophan oxidase, e.g., from *streptomyces* sp. TP-A0274) or trpDH (Tryptophan dehydrogenase, e.g., from *Nostoc punctiforme* NIES-2108) and ipdC (Indole-3-pyruvate decarboxylase, e.g., from *Enterobacter cloacae*) which together produce indole-3-acetaldehyde and FICZ from tryptophan, e.g., under the control of an inducible promoter e.g., an FNR promoter. FIG. 41C depicts one embodiment of the disclosure, in which the genetically engineered bacteria produce indole-3-acetaldehyde and FICZ from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising tdc (Tryptophan decarboxylase, e.g., from *Catharanthus roseus*), and tynA (Monoamine oxidase, e.g., from *E. coli*), which converts tryptophan to indole-3-acetaldehyde and FICZ, e.g., under the control of an inducible promoter e.g., an FNR promoter. FIG. 41D depicts one embodiment of the disclosure, in which the genetically engineered bacteria produce indole-3-acetonitrile from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit for cyp79B2, (tryptophan N-monooxygenase, e.g., from *Arabidopsis thaliana*) or cyp79B3 (tryptophan N-monooxygenase, e.g., from *Arabidopsis thaliana*), which together convert tryptophan to indole-3-acetonitrile, e.g., under the control of an inducible promoter e.g., an FNR promoter. FIG. 41E depicts one embodiment of the disclosure, in which the genetically engineered bacteria produce kynurenine from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising IDO1 (indoleamine 2,3-dioxygenase, e.g., from *Homo sapiens* or TDO2 (tryptophan 2,3-dioxygenase, e.g., from *Homo sapiens*) or BNA2 (indoleamine 2,3-dioxygenase, e.g., from *S. cerevisiae*) and Afmid: Kynurenine formamidase, e.g., from mouse) or BNA3 (kynurenine-oxoglutarate transaminase, e.g., from *S. cerevisae*) which together convert tryptophan to kynurenine, e.g., under the control of an inducible promoter e.g., an FNR promoter. FIG. 41F depicts one embodiment of the disclosure, in which the genetically engineered bacteria produce kynureninic acid from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising IDO1 (indoleamine 2,3-dioxygenase, e.g., from *Homo sapiens* or TDO2 (tryptophan 2,3-dioxygenase, e.g., from *Homo sapiens*) or BNA2 (indoleamine 2,3-dioxygenase, e.g., from *S. cerevisiae*) and Afmid: Kynurenine formamidase, e.g., from mouse) or BNA3 (kynurenine-oxoglutarate transaminase, e.g., from *S. cerevisae*) and GOT2 (Aspartate aminotransferase, mitochondrial, e.g., from *Homo sapiens* or AADAT (Kynurenine/alpha-aminoadipate aminotransferase, mitochondrial, e.g., from *Homo sapiens*), or CCLB1 (Kynurenine-oxoglutarate transaminase 1, e.g., from *Homo sapiens*) or CCLB2 (kynurenine-oxoglutarate transaminase 3, e.g., from *Homo sapiens*, which together produce kynureninic acid from tryptophan, under the control of an inducible promoter, e.g., an FNR promoter. FIG. 41G depicts one embodiment of the disclosure, in which the genetically engineered bacteria produce indole from tryptophan. The optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit for tnaA (tryptophanase, e.g., from *E. coli*), which converts tryptophan to indole, e.g., under the control of an inducible promoter e.g., an FNR promoter. FIG. 41H depicts one embodiment of the disclosure, in which the genetically engineered bacteria produce indole-3-carbinol, indole-3-aldehyde, 3,3' diindolylmethane (DIM), indolo(3,2-b) carbazole (ICZ) from indole glucosinolate taken up through the diet. The genetically engineered bacteria comprise a circuit comprising pne2 (myrosinase, e.g., from *Arabidopsis thaliana*) under the control of an inducible promoter, e.g. an FNR promoter. The engineered bacterium shown in any of FIG. 41A, FIG. 41B, FIG. 41C, FIG. 41D, FIG. 41E, FIG. 41F, FIG. 41G and FIG. 41H may also have an auxotrophy, e.g., in one example, the thyA gene can be been mutated in the *E. coli* Nissle genome, so thymidine must be supplied in the culture medium to support growth.

In FIG. 42A, the optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising aro9

(L-tryptophan aminotransferase, e.g., from *S. cerevisae*) or aspC (aspartate aminotransferase, e.g., from *E. coli*, or taa1 (L-tryptophan-pyruvate aminotransferase, e.g., from *Arabidopsis thaliana*) or staO (L-tryptophan oxidase, e.g., from *streptomyces* sp. TP-A0274) or trpDH (Tryptophan dehydrogenase, e.g., from *Nostoc punctiforme* NIES-2108) and ipdC (Indole-3-pyruvate decarboxylase, e.g., from *Enterobacter cloacae*) and iad1 (Indole-3-acetaldehyde dehydrogenase, e.g., from *Ustilago maydis*) or AAO1 (Indole-3-acetaldehyde oxidase, e.g., from *Arabidopsis thaliana*) which together produce indole-3-acetic acid from tryptophan, e.g., under the control of an inducible promoter e.g., an FNR promoter. In FIG. 42B the optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising tdc (Tryptophan decarboxylase, e.g., from *Catharanthus roseus*) of tynA (Monoamine oxidase, e.g., from *E. coli*) and or iad1 (Indole-3-acetaldehyde dehydrogenase, e.g., from *Ustilago maydis*) or AAO1 (Indole-3-acetaldehyde oxidase, e.g., from *Arabidopsis thaliana*), e.g., under the control of an inducible promoter e.g., an FNR promoter. In FIG. 42C the optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising aro9 (L-tryptophan aminotransferase, e.g., from *S. cerevisae*) or aspC (aspartate aminotransferase, e.g., from *E. coli*, or taa1 (L-tryptophan-pyruvate aminotransferase, e.g., from *Arabidopsis thaliana*) or staO (L-tryptophan oxidase, e.g., from *streptomyces* sp. TP-A0274) or trpDH (Tryptophan dehydrogenase, e.g., from *Nostoc punctiforme* NIES-2108) and yuc2 (indole-3-pyruvate monoxygenase, e.g., from *Arabidopsis thaliana*) e.g., under the control of an inducible promoter e.g., an FNR promoter. In FIG. 42D the optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising IaaM (Tryptophan 2-monooxygenase e.g., from *Pseudomonas savastanoi*) and iaaH (Indoleacetamide hydrolase, e.g., from *Pseudomonas savastanoi*), e.g., under the control of an inducible promoter e.g., an FNR promoter. In FIG. 42E the optional circuits for tryptophan production are as depicted and described in FIG. 39. The strain optionally comprises additional circuits as depicted and/or described in FIG. 45A and/or FIG. 45B. Alternatively, optionally, tryptophan can be imported through a transporter. In addition, the genetically engineered bacteria comprise a circuit comprising cyp79B2 (tryptophan N-monooxygenase, e.g., from *Arabidopsis thaliana*) or cyp79B3 (tryptophan N-monooxygenase, e.g., from *Arabidopsis thaliana* and cyp71a13 (indoleacetaldoxime dehydratase, e.g., from *Arabidopsis thaliana*) and nit1 (Nitrilase, e.g., from *Arabidopsis thaliana*) and iaaH (Indoleacetamide hydrolase, e.g., from *Pseudomonas savastanoi*), e.g., under the control of an inducible promoter e.g., an FNR promoter. The engineered bacterium shown in any of FIG. 42A, FIG. 42B, FIG. 42C, FIG. 42D, and FIG. 42E may also have an auxotrophy, e.g., in one example, the thyA gene can be been mutated in the *E. coli* Nissle genome, so thymidine must be supplied in the culture medium to support growth.

FIG. 43A depicts a schematic of an indole-3-propionic acid (IPA) synthesis circuit. IPA produced by the gut micro bioata has a significant positive effect on barrier integrity. IPA does not signal through AhR, but rather through a different receptor (PXR) (Venkatesh et al., Symbiotic Bacterial Metabolites Regulate Gastrointestinal Barrier Function via the Xenobiotic Sensor PXR and Toll-like Receptor 4; Immunity 41, 296-310, Aug. 21, 2014). In some embodiments, IPA can be produced in a synthetic circuit by expressing two enzymes, a tryptophan ammonia lyase and an indole-3-acrylate reductase (e.g., Tryptophan ammonia lyase (WAL) (e.g., from *Rubrivivax benzoatilyticus*) and indole-3-acrylate reductase (e.g., from *Clostridum botulinum*). Tryptophan ammonia lyase converts tryptophan to indole-3-acrylic acid, and indole-3-acrylate reductase converts indole-3-acrylic acid into IPA. Without wishing to be bound by theory, no oxygen is needed for this reaction, allowing it to proceed under low or no oxygen conditions, e.g., as those found in the mammalian gut. The strains further comprise optional circuits for tryptophan production are as depicted and described in FIG. 39 and/or FIG. 45A and/or FIG. 45B.

FIG. 43B depicts a schematic of another indole-3-propionic acid (IPA) synthesis circuit. Enzymes are as follows: 1. TrpDH: tryptophan dehydrogenase, e.g., from from *Nostoc punctiforme* NIES-2108; FldH1/FldH2: indole-3-lactate dehydrogenase, e.g., from *Clostridium sporogenes*; FldA: indole-3-propionyl-CoA:indole-3-lactate CoA transferase, e.g., from *Clostridium sporogenes*; FldBC: indole-3-lactate dehydratase, e.g., from *Clostridium sporogenes*; FldD: indole-3-acrylyl-CoA reductase, e.g., from *Clostridium sporogenes*; AcuI: acrylyl-CoA reductase, e.g., from *Rhodobacter sphaeroides*. Tryptophan dehydrogenase (EC 1.4.1.19) is an enzyme that catalyzes the reversible chemical reaction converting L-tryptophan, NAD(P) and water to (indol-3-yl)pyruvate $NH_3$, NAD(P)H and $H^+$. Indole-3-lactate dehydrogenase ((EC 1.1.1.110, e.g., *Clostridium sporogenes* or *Lactobacillus casei*) converts (indol-3yl)pyruvate and NADH and H+ to indole-3-lactate and NAD+. Indole-3-propionyl-CoA:indole-3-lactate CoA transferase (FldA) converts indole-3-lactate and indol-3-propionyl-CoA to indole-3-propionic acid and indole-3-lactate-CoA. Indole-3-acrylyl-CoA reductase (FldD) and acrylyl-CoA reductase (AcuI) convert indole-3-acrylyl-CoA to indole-3-propionyl-CoA. Indole-3-lactate dehydratase (FldBC) converts indole-3-lactate-CoA to indole-3-acrylyl-CoA. The strains further comprise optional circuits for tryptophan production are as depicted and described in FIG. 39 and/or FIG. 45A and/or FIG. 45B.

FIG. 44A depicts a bar graph showing tryptophan production by various tryptophan producing strains. The data show expressing a feedback resistant form of AroG (AroG$^{fbr}$) is necessary to get tryptophan production. Additionally, using a feedback resistant trpE (trpE$^{fbr}$) has a positive effect on tryptophan production. FIG. 44B shows tryptophan production from a strain comprising a tet-trpE$^{fbr}$DCBA, tet-aroG$^{fbr}$ construct, comparing glucose and glucuronate as carbon sources in the presence and absence of oxygen. It takes *E. coli* two molecules of phosphoenolpyruvate (PEP) to produce one molecule of tryptophan. When glucose is used as the carbon source, 50% of all available PEP is used to import glucose into the cell through the PTS system (Phosphotransferase system). Tryptophan production is improved by using a non-PTS sugar (glucuronate) aerobically. The data also show the positive effect of deleting tnaA (only at early time point aerobically). FIG. 44C depicts a bar graph showing improved tryptophan production by engineered strain comprising ΔtrpRΔtnaA, tet-trpE$^{fbr}$DCBA, tet-aroG$^{fbr}$ through the addition of serine.

FIG. 45A depicts a tryptophan producing strain, in which tryptophan is produced from the chorismate precursor through expression of the trpE, trpG-D, trpC-F, trpB and trpA genes. AroG and TrpE are replaced with feedback resistant versions to improve tryptophan production. Optionally, bacteria may comprise any of the transporters and/or additional tryptophan circuits depicted in FIG. 39 and/or described in the description of FIG. 39 and/or FIG. 45B. Optionally, Trp Repressor and/or the tnaA gene (encoding a tryptophanase converting Trp into indole) are deleted to further increase levels of tryptophan produced. The bacteria may also include gene sequence(s) for yddG to express YddG to assist in the exportation of tryptophan. FIG. 45B depicts a tryptophan producing strain, in which tryptophan is produced from the chorismate precursor through expression of the trpE, trpG-D, trpC-F, trpB and trpA genes. AroG and TrpE are replaced with feedback resistant versions to improve tryptophan production. The strain further comprises either a wild type or a feedback resistant SerA gene. *Escherichia coli* serA-encoded 3-phosphoglycerate (3PG) dehydrogenase catalyzes the first step of the major phosphorylated pathway of L-serine (Ser) biosynthesis. This step is an oxidation of 3PG to 3-phosphohydroxypyruvate (3PHP) with the concomitant reduction of NADI to NADH. *E. coli* uses one serine for each tryptophan produced. As a result, by expressing serA, tryptophan production is improved. Optionally, bacteria may comprise any of the transporters and/or additional tryptophan circuits depicted in FIG. 39 and/or described in the description of FIG. 39. Optionally, Trp Repressor and/or the tnaA gene (encoding a tryptophanase converting Trp into indole) are deleted to further increase levels of tryptophan produced. The bacteria may also include gene sequence(s) for yddG to express YddG to assist in the exportation of tryptophan. FIG. 45C depicts non-limiting example of a tryptamine producing strain. Tryptophan is optionally produced from chorismate precursor, and the strain optionally comprises additional circuits as depicted and/or described in FIG. 45A and/or FIG. 45B and/or FIG. 39. Additionally, the strain comprises tdc (tryptophan decarboxylase, e.g., from *Catharanthus roseus*), which converts tryptophan into tryptamine. FIG. 45D depicts a non-limiting example of an indole-3-acetate producing strain. Tryptophan optionally is produced from chorismate precursor, and the strain optionally comprises additional circuits as depicted and/or described in FIG. 45A and/or FIG. 45B and/or FIG. 39. Additionally, the strain comprises trpDH (Tryptophan dehydrogenase, e.g., from *Nostoc punctiforme* NIES-2108) and ipdC (Indole-3-pyruvate decarboxylase, e.g., from *Enterobacter cloacae*) which together produce indole-3-acetaldehyde and FICZ though an (indol-3yl)pyruvate intermediate, and iad1 (Indole-3-acetaldehyde dehydrogenase, e.g., from *Ustilago maydis*), which converts indole-3-acetaldehyde into indole-3-acetate. FIG. 45E depicts a non-limiting example of an indole-3-propionate-producing strain. Tryptophan is optionally produced from chorismate precursor, and the strain optionally comprises additional circuits as depicted and/or described in FIG. 45A and/or FIG. 45B and/or FIG. 39. Additionally, the strain comprises a circuit as described in FIG. 44, comprising trpDH (Tryptophan dehydrogenase, e.g., from *Nostoc punctiforme* NIES-2108, which produces (indol-3yl)pyruvate from tryptophan), fldA (indole-3-propionyl-CoA:indole-3-lactate CoA transferase, e.g., from *Clostridium sporogenes*, which converts converts indole-3-lactate and indol-3-propionyl-CoA to indole-3-propionic acid and indole-3-lactate-CoA), fldB and fldC (indole-3-lactate dehydratase e.g., from *Clostridium sporogenes*, which converts indole-3-lactate-CoA to indole-3-acrylyl-CoA) fldD and/or AcuI: (indole-3-acrylyl-CoA reductase, e.g., from *Clostridium sporogenes* and/or acrylyl-CoA reductase, e.g., from *Rhodobacter sphaeroides*, which convert indole-3-acrylyl-CoA to indole-3-propionyl-CoA). The circuits further comprise fldH1 and/or fldH2 (indole-3-lactate dehydrogenase 1 and/or 2, e.g., from *Clostridium sporogenes*), which converts (indol-3-yl)pyruvate into indole-3-lactate).

FIG. 49A depicts a schematic of an engineered bacterium comprising, a circuit for butyrate production, a circuit for propionate production, and a circuit for production of one or more interleukins relevant to IBD. FIG. 49B depicts a schematic of an engineered bacterium comprising three circuits, a circuit for butyrate production, a circuit for GLP-2 expression and and a circuit for production of one or more interleukins relevant to IBD.

FIG. 55A also depicts another non-limiting embodiment of the disclosure, wherein the expression of an essential gene not found in the recombinant bacteria is activated by an exogenous environmental signal. In the absence of arabinose, the AraC transcription factor adopts a conformation that represses transcription of the essential gene under the control of the araBAD promoter and the bacterial cell cannot survive. In the presence of arabinose, the AraC transcription factor undergoes a conformational change that allows it to bind to and activate the araBAD promoter, which induces expression of the essential gene and maintains viability of the bacterial cell. FIG. 55B depicts a non-limiting embodiment of the disclosure, where an anti-toxin is expressed from a constitutive promoter, and expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the araBAD promoter, which induces expression of TetR, thus preventing expression of a toxin. However, when arabinose is not present, TetR is not expressed, and the toxin is expressed, eventually overcoming the anti-toxin and killing the cell. The constitutive promoter regulating expression of the anti-toxin should be a weaker promoter than the promoter driving expression of the toxin. The araC gene is under the control of a constitutive promoter in this circuit. FIG. 55C depicts another non-limiting embodiment of the disclosure, wherein the expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the araBAD promoter, which induces expression of the Tet repressor (TetR) and an anti-toxin. The anti-toxin builds up in the recombinant bacterial cell, while TetR prevents expression of a toxin (which is under the control of a promoter having a TetR binding site). However, when arabinose is not present, both the anti-toxin and TetR are not expressed. Since TetR is not present to repress expression of the toxin, the toxin is expressed and kills the cell. The araC gene is either under the control of a constitutive promoter or an inducible promoter (e.g., AraC promoter) in this circuit.

FIG. 62A depicts a schematic representation of the lacZ gene under the control of an exemplary FNR promoter ($P_{fnrS}$). LacZ encodes the β-galactosidase enzyme and is a common reporter gene in bacteria. FIG. 62B depicts FNR promoter activity as a function of β-galactosidase activity in SYN340. SYN340, an engineered bacterial strain harboring a low-copy fnrS-lacZ fusion gene, was grown in the presence or absence of oxygen. Values for standard β-galactosidase colorimetric assays are expressed in Miller units (Miller, 1972). These data suggest that the fnrS promoter begins to drive high-level gene expression within 1 hr under anaerobic conditions. FIG. 62C depicts the growth of bacterial cell cultures expressing lacZ over time, both in the presence and absence of oxygen.

FIG. 63A and FIG. 63B depict bar graphs of reporter constructs activity. FIG. 69A depicts a graph of an ATC-inducible reporter construct expression and FIG. 63B depicts a graph of a nitric oxide-inducible reporter construct expression. These constructs, when induced by their cognate inducer, lead to expression of GFP. Nissle cells harboring plasmids with either the control, ATC-construct induced across a range of concentrations. Promoter activity is expressed as relative florescence units. FIG. 63C depicts a schematic of the constructs. FIG. 63D depicts a dot blot of bacteria harboring a plasmid expressing NsrR under control of a constitutive promoter and the reporter gene gfp (green fluorescent protein) under control of an NsrR-inducible promoter. DSS-treated mice serve as exemplary models for HE. As in HE subjects, the guts of mice are damaged by supplementing drinking water with 2-3% dextran sodium sulfate (DSS). Chemiluminescent is shown for NsrR-regulated promoters induced in DSS-treated mice.

FIG. 66A and FIG. 66B depict a schematic diagrams of a wild-type clbA construct (FIG. 66A) and a schematic diagram of a clbA knockout construct (FIG. 66B).

DESCRIPTION OF EMBODIMENTS

Figure 1A:
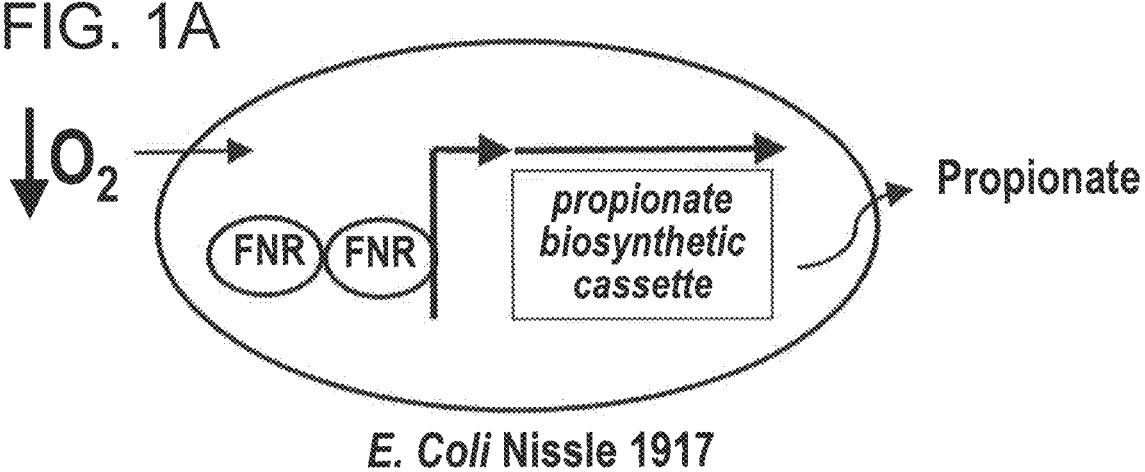
FIG. 1A, FIG. 1B, FIG. 1C, FIG. 1D, FIG. 1E, and FIG. 1F depict schematics of E. coli that are genetically engineered to express a propionate biosynthesis cassette (FIG. 1A), a butyrate biosynthesis cassette (FIG. 1B), an acetate biosynthesis cassette (FIG. 1C), a cassette for the expression of GLP-2 (FIG. 1D), a cassette for the expression of human IL-10 (FIG. 1E) under the control of a FNR-responsive promoter. The genetically engineered E coli depicted in FIG. 1D, FIG. 1E, and FIG. 1F may further comprise a secretion system for secretion of the expressed polypeptide out of the cell.
Figure 1B:
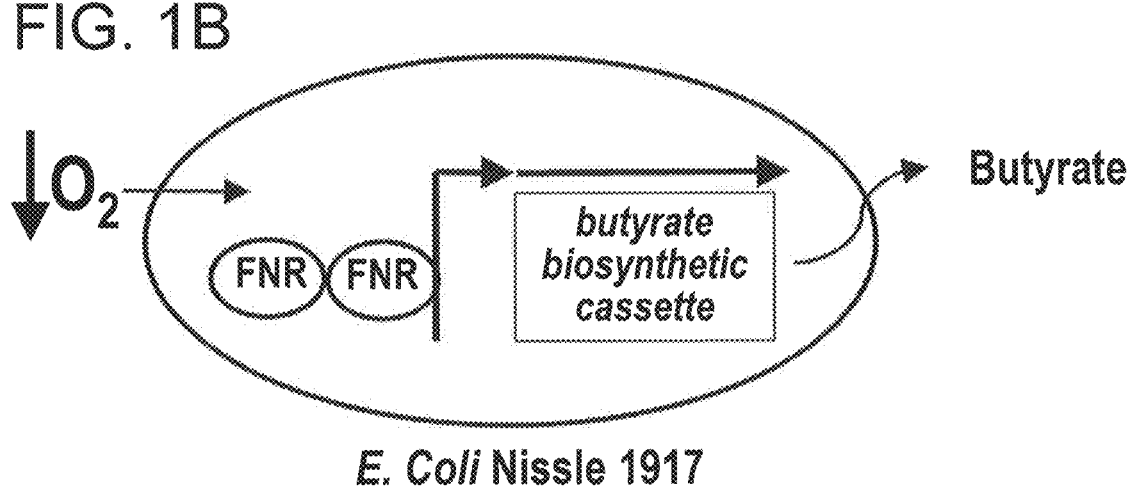
Figure 1C:
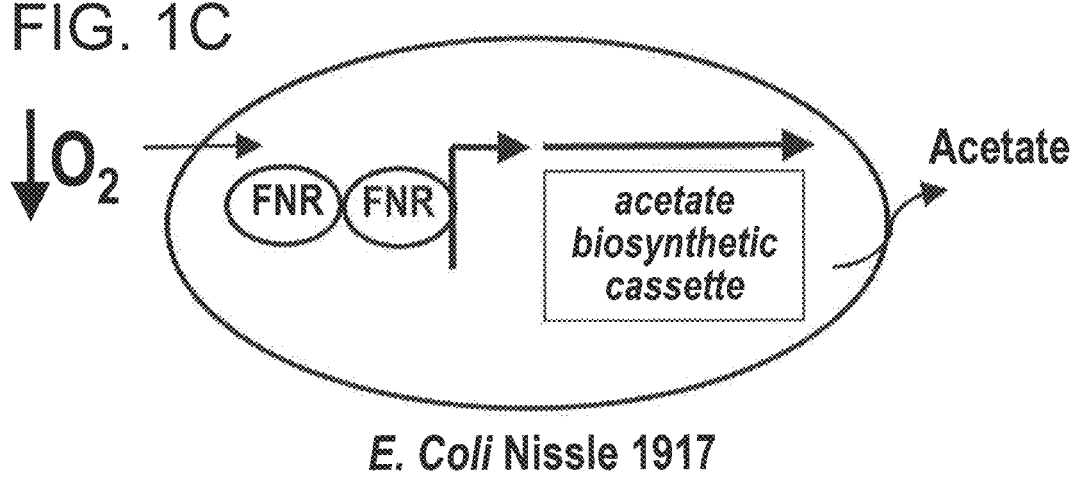
Figure 1D:
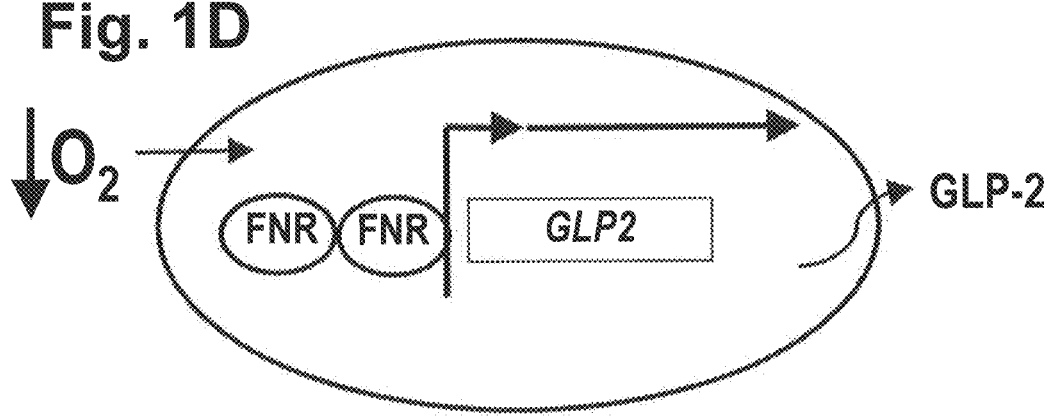
Figure 1E:
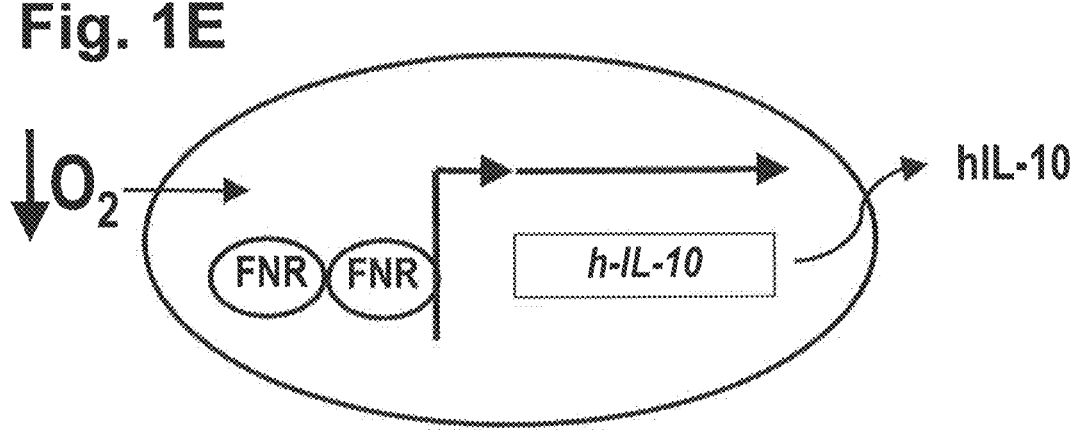
Figure 1F:
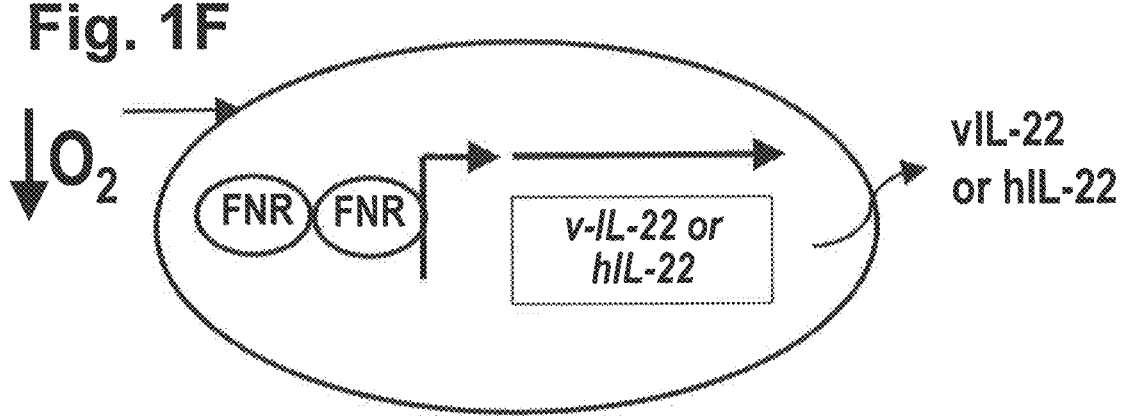

The present disclosure includes genetically engineered bacteria, pharmaceutical compositions thereof, and methods of reducing gut inflammation, enhancing gut barrier function, and/or treating or preventing autoimmune disorders. In some embodiments, the genetically engineered bacteria comprise at least one non-native gene and/or gene cassette for producing a non-native anti-inflammation and/or gut barrier function enhancer molecule(s). In some embodiments, the at least one gene and/or gene cassette is further operably linked to a regulatory region that is controlled by a transcription factor that is capable of sensing an inducing condition, e.g., a low-oxygen environment, the presence of ROS, or the presence of RNS. The genetically engineered bacteria are capable of producing the anti-inflammation and/or gut barrier function enhancer molecule(s) in inducing environments, e.g., in the gut. Thus, the genetically engineered bacteria and pharmaceutical compositions comprising those bacteria may be used to treat or prevent autoimmune disorders and/or diseases or conditions associated with gut inflammation and/or compromised gut barrier function, including IBD.

In order that the disclosure may be more readily understood, certain terms are first defined. These definitions should be read in light of the remainder of the disclosure and as understood by a person of ordinary skill in the art. Unless defined otherwise, all technical and scientific terms used herein have the same meaning as commonly understood by a person of ordinary skill in the art. Additional definitions are set forth throughout the detailed description.

As used herein, "diseases and conditions associated with gut inflammation and/or compromised gut barrier function" include, but are not limited to, inflammatory bowel diseases, diarrheal diseases, and related diseases. "Inflammatory bowel diseases" and "IBD" are used interchangeably herein to refer to a group of diseases associated with gut inflammation, which include, but are not limited to, Crohn's disease, ulcerative colitis, collagenous colitis, lymphocytic colitis, diversion colitis, Behcet's disease, and indeterminate colitis. As used herein, "diarrheal diseases" include, but are not limited to, acute watery diarrhea, e.g., cholera; acute bloody diarrhea, e.g., dysentery; and persistent diarrhea. As used herein, related diseases include, but are not limited to, short bowel syndrome, ulcerative proctitis, proctosigmoiditis, left-sided colitis, pancolitis, and fulminant colitis.

Symptoms associated with the aforementioned diseases and conditions include, but are not limited to, one or more of diarrhea, bloody stool, mouth sores, perianal disease, abdominal pain, abdominal cramping, fever, fatigue, weight loss, iron deficiency, anemia, appetite loss, weight loss, anorexia, delayed growth, delayed pubertal development, inflammation of the skin, inflammation of the eyes, inflammation of the joints, inflammation of the liver, and inflammation of the bile ducts.

A disease or condition associated with gut inflammation and/or compromised gut barrier function may be an autoimmune disorder. A disease or condition associated with gut inflammation and/or compromised gut barrier function may be co-morbid with an autoimmune disorder. As used herein, "autoimmune disorders" include, but are not limited to, acute disseminated encephalomyelitis (ADEM), acute necrotizing hemorrhagic leukoencephalitis, Addison's disease, agammaglobulinemia, alopecia areata, amyloidosis, ankylosing spondylitis, anti-GBM/anti-TBM nephritis, antiphospholipid syndrome (APS), autoimmune angioedema, autoimmune aplastic anemia, autoimmune dysautonomia, autoimmune hemolytic anemia, autoimmune hepatitis, autoimmune hyperlipidemia, autoimmune immunodeficiency, autoimmune inner ear disease (AIED), autoimmune myocarditis, autoimmune oophoritis, autoimmune pancreatitis, autoimmune retinopathy, autoimmune thrombocytopenic purpura (ATP), autoimmune thyroid disease, autoimmune urticarial, axonal & neuronal neuropathies, Balo disease, Behcet's disease, bullous pemphigoid, cardiomyopathy, Castleman disease, celiac disease, Chagas disease, chronic inflammatory demyelinating polyneuropathy (CIDP), chronic recurrent multifocal ostomyelitis (CRMO), Churg-Strauss syndrome, cicatricial pemphigoid/benign mucosal pemphigoid, Crohn's disease, Cogan's syndrome, cold agglutinin disease, congenital heart block, Coxsackie myocarditis, CREST disease, essential mixed cryoglobulinemia, demyelinating neuropathies, dermatitis herpetiformis, dermatomyositis, Devic's disease (neuromyelitis optica), discoid lupus, Dressler's syndrome, endometriosis, eosinophilic esophagitis, eosinophilic fasciitis, erythema nodosum, experimental allergic encephalomyelitis, Evans syndrome, fibrosing alveolitis, giant cell arteritis (temporal arteritis), giant cell myocarditis, glomerulonephritis, Goodpasture's syndrome, granulomatosis with polyangiitis (GPA), Graves' disease, Guillain-Barre syndrome, Hashimoto's encephalitis, Hashimoto's thyroiditis, hemolytic anemia, Henoch-Schonlein purpura, herpes gestationis, hypogammaglobulinemia, idiopathic thrombocytopenic purpura (ITP), IgA nephropathy, IgG4-related sclerosing disease, immunoregulatory lipoproteins, inclusion body myositis, interstitial cystitis, juvenile arthritis, juvenile idiopathic arthritis, juvenile myositis, Kawasaki syndrome, Lambert-Eaton syndrome, leukocytoclastic vasculitis, lichen planus, lichen sclerosus, ligneous conjunctivitis, linear IgA disease (LAD), lupus (systemic lupus erythematosus), chronic Lyme disease, Meniere's disease, microscopic polyangiitis, mixed connective tissue disease (MCTD), Mooren's ulcer, Mucha-Habermann disease, multiple sclerosis, myasthenia gravis, myositis, narcolepsy, neuromyelitis optica (Devic's), neutropenia, ocular cicatricial pemphigoid, optic neuritis, palindromic rheumatism, PANDAS (pediatric Autoimmune Neuropsychiatric Disorders Associated with *Streptococcus*), paraneoplastic cerebellar degeneration, paroxysmal nocturnal hemoglobinuria (PNH), Parry Romberg syndrome, Parsonnage-Turner syndrome, pars planitis (peripheral uveitis), pemphigus, peripheral neuropathy, perivenous encephalomyelitis, pernicious anemia, POEMS syndrome, polyarteritis nodosa, type I, II, & III autoimmune polyglandular syndromes, polymyalgia rheumatic, polymyositis, postmyocardial infarction syndrome, postpericardiotomy syndrome, progesterone dermatitis, primary biliary cirrhosis, primary sclerosing cholangitis, psoriasis, psoriatic arthritis, idiopathic pulmonary fibrosis, pyoderma gangrenosum, pure red cell aplasia, Raynaud's phenomenon, reactive arthritis, reflex sympathetic dystrophy, Reiter's syndrome, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm & testicular autoimmunity, stiff person syndrome, subacute bacterial endocarditis (SBE), Susac's syndrome, sympathetic ophthalmia, Takayasu's arteritis, temporal arteritis/giant cell arteritis, thrombocytopenic purpura (TTP), Tolosa-Hunt syndrome, transverse myelitis, type 1 diabetes, asthma, ulcerative colitis, undifferentiated connective tissue disease (UCTD), uveitis, vasculitis, vesiculobullous dermatosis, vitiligo, and Wegener's granulomatosis.

As used herein, "anti-inflammation molecules" and/or "gut barrier function enhancer molecules" include, but are not limited to, short-chain fatty acids, butyrate, propionate, acetate, IL-2, IL-22, superoxide dismutase (SOD), GLP-2 and analogs, GLP-1, IL-10, IL-27, TGF-β1, TGF-β2, N-acylphosphatidylethanolamines (NAPEs), elafin (also called peptidase inhibitor 3 and SKALP), trefoil factor, melatonin, tryptophan, PGD$_2$, and kynurenic acid, indole metabolites, and other tryptophan metabolites, as well as other molecules disclosed herein. Such molecules may also include compounds that inhibit pro-inflammatory molecules, e.g., a single-chain variable fragment (scFv), antisense RNA, siRNA, or shRNA that neutralizes TNF-α, IFN-γ, IL-1β, IL-6, IL-8, IL-17, and/or chemokines, e.g., CXCL-8 and CCL2. Such molecules also include AHR agonists (e.g., which result in IL-22 production, e.g., indole acetic acid, indole-3-aldehyde, and indole) and and PXR agonists (e.g., IPA), as described herein. Such molecules also include HDAC inhibitors (e.g., butyrate), activators of GPR41 and/or GPR43 (e.g., butyrate and/or propionate and/or acetate), activtators of GPR109A (e.g., butyrate), inhibitors of NF-kappaB signaling (e.g., butyrate), and modulators of PPARgamma (e.g., butyrate), activators of AMPK signaling (e.g., acetate), and modulators of GLP-1 secretion. Such molecules also include hydroxyl radical scavengers and antioxidants (e.g., IPA). A molecule may be primarily anti-inflammatory, e.g., IL-10, or primarily gut barrier function enhancing, e.g., GLP-2. A molecule may be both anti-inflammatory and gut barrier function enhancing. An anti-inflammation and/or gut barrier function enhancer molecule may be encoded by a single gene, e.g., elafin is encoded by the PI3 gene. Alternatively, an anti-inflammation and/or gut barrier function enhancer molecule may be synthesized by a biosynthetic pathway requiring multiple genes, e.g., butyrate. These molecules may also be referred to as therapeutic molecules. In some instances, the "anti-inflammation molecules" and/or "gut barrier function enhancer molecules" are referred to herein as "effector molecules" or "therapeutic molecules" or "therapeutic polypeptides".

As used herein, the term "recombinant microorganism" refers to a microorganism, e.g., bacterial, yeast, or viral cell, or bacteria, yeast, or virus, that has been genetically modified from its native state. Thus, a "recombinant bacterial cell" or "recombinant bacteria" refers to a bacterial cell or bacteria that have been genetically modified from their native state. For instance, a recombinant bacterial cell may have nucleotide insertions, nucleotide deletions, nucleotide rearrangements, and nucleotide modifications introduced into their DNA. These genetic modifications may be present in the chromosome of the bacteria or bacterial cell, or on a plasmid in the bacteria or bacterial cell. Recombinant bacterial cells disclosed herein may comprise exogenous nucleotide sequences on plasmids. Alternatively, recombinant bacterial cells may comprise exogenous nucleotide sequences stably incorporated into their chromosome.

A "programmed or engineered microorganism" refers to a microorganism, e.g., bacterial or viral cell, or bacteria or virus, that has been genetically modified from its native state to perform a specific function. Thus, a "programmed or engineered bacterial cell" or "programmed or engineered bacteria" refers to a bacterial cell or bacteria that has been genetically modified from its native state to perform a specific function. In certain embodiments, the programmed or engineered bacterial cell has been modified to express one or more proteins, for example, one or more proteins that have a therapeutic activity or serve a therapeutic purpose. The programmed or engineered bacterial cell may additionally have the ability to stop growing or to destroy itself once the protein(s) of interest have been expressed.

As used herein, the term "gene" refers to a nucleic acid fragment that encodes a protein or fragment thereof, optionally including regulatory sequences preceding (5' non-coding sequences) and following (3' non-coding sequences) the coding sequence. In one embodiment, a "gene" does not include regulatory sequences preceding and following the coding sequence. A "native gene" refers to a gene as found in nature, optionally with its own regulatory sequences preceding and following the coding sequence. A "chimeric gene" refers to any gene that is not a native gene, optionally comprising regulatory sequences preceding and following the coding sequence, wherein the coding sequences and/or the regulatory sequences, in whole or in part, are not found together in nature. Thus, a chimeric gene may comprise regulatory sequences and coding sequences that are derived from different sources, or regulatory and coding sequences that are derived from the same source, but arranged differently than is found in nature.

As used herein, the term "gene sequence" is meant to refer to a genetic sequence, e.g., a nucleic acid sequence. The gene sequence or genetic sequence is meant to include a complete gene sequence or a partial gene sequence. The gene sequence or genetic sequence is meant to include sequence that encodes a protein or polypeptide and is also menat to include genetic sequence that does not encode a protein or polypeptide, e.g., a regulatory sequence, leader sequence, signal sequence, or other non-protein coding sequence.

In some embodiments, the term "gene" or "gene sequence" is meant to refer to a nucleic acid sequence encoding any of the anti-inflammatory and gut barrier function enhancing molecules described herein, e.g., IL-2, IL-22, superoxide dismutase (SOD), kynurenine, GLP-2, GLP-1, IL-10, IL-27, TGF-β1, TGF-β2, N-acylphosphatidylethanolamines (NAPEs), elafin, and trefoil factor, as well as others. The nucleic acid sequence may comprise the entire gene sequence or a partial gene sequence encoding a functional molecule. The nucleic acid sequence may be a natural sequence or a synthetic sequence. The nucleic acid sequence may comprise a native or wild-type sequence or may comprise a modified sequence having one or more insertions, deletions, substitutions, or other modifications, for example, the nucleic acid sequence may be codon-optimized.

As used herein, a "heterologous" gene or "heterologous sequence" refers to a nucleotide sequence that is not normally found in a given cell in nature. As used herein, a heterologous sequence encompasses a nucleic acid sequence that is exogenously introduced into a given cell and can be a native sequence (naturally found or expressed in the cell) or non-native sequence (not naturally found or expressed in the cell) and can be a natural or wild-type sequence or a variant, non-natural, or synthetic sequence. "Heterologous gene" includes a native gene, or fragment thereof, that has been introduced into the host cell in a form that is different from the corresponding native gene. For example, a heterologous gene may include a native coding sequence that is a portion of a chimeric gene to include non-native regulatory regions that is reintroduced into the host cell. A heterologous gene may also include a native gene, or fragment thereof, introduced into a non-native host cell. Thus, a heterologous gene may be foreign or native to the recipient cell; a nucleic acid sequence that is naturally found in a given cell but expresses an unnatural amount of the nucleic acid and/or the polypeptide which it encodes; and/or two or more nucleic acid sequences that are not found in the same relationship to each other in nature. As used herein, the term "endogenous gene" refers to a native gene in its natural location in the genome of an organism. As used herein, the term "transgene" refers to a gene that has been introduced into the host organism, e.g., host bacterial cell, genome.

As used herein, a "non-native" nucleic acid sequence refers to a nucleic acid sequence not normally present in a microorganism, e.g., an extra copy of an endogenous sequence, or a heterologous sequence such as a sequence from a different species, strain, or substrain of bacteria or virus, or a sequence that is modified and/or mutated as compared to the unmodified sequence from bacteria or virus of the same subtype. In some embodiments, the non-native nucleic acid sequence is a synthetic, non-naturally occurring sequence (see, e.g., Purcell et al., 2013). The non-native nucleic acid sequence may be a regulatory region, a promoter, a gene, and/or one or more genes in gene cassette. In some embodiments, "non-native" refers to two or more nucleic acid sequences that are not found in the same relationship to each other in nature. The non-native nucleic acid sequence may be present on a plasmid or chromosome. In some embodiments, the genetically engineered microorganism of the disclosure comprises a gene that is operably linked to a promoter that is not associated with said gene in nature. For example, in some embodiments, the genetically engineered bacteria disclosed herein comprise a gene that is operably linked to a directly or indirectly inducible promoter that is not associated with said gene in nature, e.g., an FNR responsive promoter (or other promoter disclosed herein) operably linked to an anti-inflammatory or gut barrier enhancer molecule. In some embodiments, the genetically engineered virus of the disclosure comprises a gene that is operably linked to a directly or indirectly inducible promoter that is not associated with said gene in nature, e.g., a promoter operably linked to a gene encoding an anti-inflammatory or gut barrier enhancer molecule.

As used herein, the term "coding region" refers to a nucleotide sequence that codes for a specific amino acid sequence. The term "regulatory sequence" refers to a nucleotide sequence located upstream (5' non-coding sequences), within, or downstream (3' non-coding sequences) of a coding sequence, and which influences the transcription, RNA processing, RNA stability, or translation of the associated coding sequence. Examples of regulatory sequences include, but are not limited to, promoters, translation leader sequences, effector binding sites, signal sequences, and stem-loop structures. In one embodiment, the regulatory sequence comprises a promoter, e.g., an FNR responsive promoter or other promoter disclosed herein.

As used herein, a "gene cassette" or "operon" encoding a biosynthetic pathway refers to the two or more genes that are required to produce an anti-inflammatory or gut barrier enhancer molecule. In addition to encoding a set of genes capable of producing said molecule, the gene cassette or operon may also comprise additional transcription and translation elements, e.g., a ribosome binding site.

A "butyrogenic gene cassette," "butyrate biosynthesis gene cassette," and "butyrate operon" are used interchangeably to refer to a set of genes capable of producing butyrate in a biosynthetic pathway. Unmodified bacteria that are capable of producing butyrate via an endogenous butyrate biosynthesis pathway include, but are not limited to, *Clostridium*, *Peptoclostridium*, *Fusobacterium*, *Butyrivibrio*, *Eubacterium*, and *Treponema*. The genetically engineered bacteria of the invention may comprise butyrate biosynthesis genes from a different species, strain, or substrain of bacteria, or a combination of butyrate biosynthesis genes from different species, strains, and/or substrains of bacteria. A butyrogenic gene cassette may comprise, for example, the eight genes of the butyrate production pathway from *Peptoclostridium difficile* (also called *Clostridium difficile*): bcd2, etfB3, etfA3, thiA1, hbd, crt2, pbt, and buk, which encode butyryl-CoA dehydrogenase subunit, electron transfer flavoprotein subunit beta, electron transfer flavoprotein subunit alpha, acetyl-CoA C-acetyltransferase, 3-hydroxybutyryl-CoA dehydrogenase, crotonase, phosphate butyryltransferase, and butyrate kinase, respectively (Aboulnaga et al., 2013). One or more of the butyrate biosynthesis genes may be functionally replaced or modified, e.g., codon optimized. *Peptoclostridium difficile* strain 630 and strain 1296 are both capable of producing butyrate, but comprise different nucleic acid sequences for etfA3, thiA1, hbd, crt2, pbt, and buk. A butyrogenic gene cassette may comprise bcd2, etfB3, etfA3, and thiA1 from *Peptoclostridium difficile* strain 630, and hbd, crt2, pbt, and buk from *Peptoclostridium difficile* strain 1296. Alternatively, a single gene from *Treponema denticola* (ter, encoding trans-2-enoynl-CoA reductase) is capable of functionally replacing all three of the bcd2, etfB3, and etfA3 genes from *Peptoclostridium difficile*. Thus, a butyrogenic gene cassette may comprise thiA1, hbd, crt2, pbt, and buk from *Peptoclostridium difficile* and ter from *Treponema denticola*. The butyrogenic gene cassette may comprise genes for the aerobic biosynthesis of butyrate and/or genes for the anaerobic or microaerobic biosynthesis of butyrate. In another example of a butyrate gene cassette, the pbt and buk genes are replaced with tesB (e.g., from *E coli*). Thus a butyrogenic gene cassette may comprise ter, thiA1, hbd, crt2, and tesB.

Likewise, a "propionate gene cassette" or "propionate operon" refers to a set of genes capable of producing propionate in a biosynthetic pathway. Unmodified bacteria that are capable of producing propionate via an endogenous propionate biosynthesis pathway include, but are not limited to, *Clostridium propionicum*, *Megasphaera elsdenii*, and *Prevotella ruminicola*. The genetically engineered bacteria of the invention may comprise propionate biosynthesis genes from a different species, strain, or substrain of bacteria, or a combination of propionate biosynthesis genes from different species, strains, and/or substrains of bacteria. In some embodiments, the propionate gene cassette comprises acrylate pathway propionate biosynthesis genes, e.g., pct, lcdA, lcdB, lcdC, etfA, acrB, and acrC, which encode propionate CoA-transferase, lactoyl-CoA dehydratase A, lactoyl-CoA dehydratase B, lactoyl-CoA dehydratase C, electron transfer flavoprotein subunit A, acryloyl-CoA reductase B, and acryloyl-CoA reductase C, respectively (Hetzel et al., 2003, Selmer et al., 2002, and Kandasamy 2012 Engineering *Escherichia coli* with acrylate pathway genes for propionic acid synthesis and its impact on mixed-acid fermentation). This operon catalyses the reduction of lactate to propionate. Dehydration of (R)-lactoyl-CoA leads to the production of the intermediate acryloyl-CoA by lactoyl-CoA dehydratase (LcdABC). Acrolyl-CoA is converted to propionyl-CoA by acrolyl-CoA reductase (EtfA, AcrBC). In some embodiments, the rate limiting step catalyzed by the enzymes encoded by etfA, acrB and acrC, are replaced by the acuI gene from *R. sphaeroides*. This gene product catalyzes the NADPH-dependent acrylyl-CoA reduction to produce propionyl-CoA (Acrylyl-Coenzyme A Reductase, an Enzyme Involved in the Assimilation of 3-Hydroxypropionate by *Rhodobacter sphaeroides*; Asao 2013). Thus the propionate cassette comprises pct, lcdA, lcdB, lcdC, and acuI. In another embodiment, the homolog of AcuI in *E coli*, YhdH is used (see. e.g., Structure of *Escherichia coli* YhdH, a putative quinone oxidoreductase. Sulzenbacher 2004). This the propionate cassette comprises pct, lcdA, lcdB, lcdC, and yhdH. In alternate embodiments, the propionate gene cassette comprises pyruvate pathway propionate biosynthesis genes (see, e.g., Tseng et al., 2012), e.g., thrAfbr, thrB, thrC, ilvAfbr, aceE, aceF, and lpd, which encode homoserine dehydrogenase 1, homoserine kinase, L-threonine synthase, L-threonine dehydratase, pyruvate dehydrogenase, dihydrolipoamide acetyltrasferase, and dihydrolipoyl dehydrogenase, respectively. In some embodiments, the propionate gene cassette further comprises tesB, which encodes acyl-CoA thioesterase.

In another example of a propionate gene cassette comprises the genes of the Sleeping Beauty Mutase operon, e.g., from *E. coli* (sbm, ygfD, ygfG, ygfH). Recently, this pathway has been considered and utilized for the high yield industrial production of propionate from glycerol (Akawi et al., Engineering *Escherichia coli* for high-level production of propionate; J Ind Microbiol Biotechnol (2015) 42:1057-1072, the contents of which is herein incorporated by reference in its entirety). In addition, as described herein, it has been found that this pathway is also suitable for production of proprionate from glucose, e.g. by the genetically engineered bacteria of the disclosure. The SBM pathway is cyclical and composed of a series of biochemical conversions forming propionate as a fermentative product while regenerating the starting molecule of succinyl-CoA. Sbm (methylmalonyl-CoA mutase) converts succinyl CoA to L-methylmalonylCoA, YgfD is a Sbm-interacting protein kinase with GTPase activity, ygfG (methylmalonylCoA decarboxylase) converts L-methylmalonylCoA into PropionylCoA, and ygfH (propionyl-CoA/succinylCoA transferase) converts propionylCoA into propionate and succinate into succinylCoA (Sleeping beauty mutase (sbm) is expressed and interacts with ygfd in *Escherichia coli*; Froese 2009). This pathway is very similar to the oxidative propionate pathway of Propionibacteria, which also converts succinate to propionate. Succinyl-CoA is converted to R-methylmalonyl-CoA by methymalonyl-CoA mutase (mutAB). This is in turn converted to S-methylmalonyl-CoA via methymalonyl-CoA epimerase (GI:18042134). There are three genes which encode methylmalonyl-CoA carboxytransferase (mmdA, PFREUD_18870, bccp) which converts methylmalonyl-CoA to propionyl-CoA.

The propionate gene cassette may comprise genes for the aerobic biosynthesis of propionate and/or genes for the anaerobic or microaerobic biosynthesis of propionate. One or more of the propionate biosynthesis genes may be functionally replaced or modified, e.g., codon optimized.

An "acetate gene cassette" or "acetate operon" refers to a set of genes capable of producing acetate in a biosynthetic pathway. Bacteria "synthesize acetate from a number of carbon and energy sources," including a variety of substrates such as cellulose, lignin, and inorganic gases, and utilize different biosynthetic mechanisms and genes, which are known in the art (Ragsdale et al., 2008). The genetically engineered bacteria of the invention may comprise acetate biosynthesis genes from a different species, strain, or substrain of bacteria, or a combination of acetate biosynthesis genes from different species, strains, and/or substrains of bacteria. *Escherichia coli* are capable of consuming glucose and oxygen to produce acetate and carbon dioxide during aerobic growth (Kleman et al., 1994). Several bacteria, such as *Acetitomaculum, Acetoanaerobium, Acetohalobium, Acetonema, Balutia, Butyribacterium, Clostridium, Moorella, Oxobacter, Sporomusa,* and *Thermoacetogenium,* are acetogenic anaerobes that are capable of converting CO or $CO_2+H_2$ into acetate, e.g., using the Wood-Ljungdahl pathway (Schiel-Bengelsdorf et al, 2012). Genes in the Wood-Ljungdahl pathway for various bacterial species are known in the art. The acetate gene cassette may comprise genes for the aerobic biosynthesis of acetate and/or genes for the anaerobic or microaerobic biosynthesis of acetate. One or more of the acetate biosynthesis genes may be functionally replaced or modified, e.g., codon optimized.

Each gene or gene cassette may be present on a plasmid or bacterial chromosome. In addition, multiple copies of any gene, gene cassette, or regulatory region may be present in the bacterium, wherein one or more copies of the gene, gene cassette, or regulatory region may be mutated or otherwise altered as described herein. In some embodiments, the genetically engineered bacteria are engineered to comprise multiple copies of the same gene, gene cassette, or regulatory region in order to enhance copy number or to comprise multiple different components of a gene cassette performing multiple different functions.

Each gene or gene cassette may be operably linked to a promoter that is induced under low-oxygen conditions. "Operably linked" refers a nucleic acid sequence, e.g., a gene or gene cassette for producing an anti-inflammatory or gut barrier enhancer molecule, that is joined to a regulatory region sequence in a manner which allows expression of the nucleic acid sequence, e.g., acts in cis. A regulatory region "Operably linked" refers to the association of nucleic acid sequences on a single nucleic acid fragment so that the function of one is affected by the other. A regulatory element is operably linked with a coding sequence when it is capable of affecting the expression of the gene coding sequence, regardless of the distance between the regulatory element and the coding sequence. More specifically, operably linked refers to a nucleic acid sequence, e.g., a gene encoding an anti-inflammatory or gut barrier enhancer molecule, that is joined to a regulatory sequence in a manner which allows expression of the nucleic acid sequence, e.g., the gene encoding the anti-inflammatory or gut barrier enhancer molecule. In other words, the regulatory sequence acts in cis. In one embodiment, a gene may be "directly linked" to a regulatory sequence in a manner which allows expression of the gene. In another embodiment, a gene may be "indirectly linked" to a regulatory sequence in a manner which allows expression of the gene. In one embodiment, two or more genes may be directly or indirectly linked to a regulatory sequence in a manner which allows expression of the two or more genes. A regulatory region or sequence is a nucleic acid that can direct transcription of a gene of interest and may comprise promoter sequences, enhancer sequences, response elements, protein recognition sites, inducible elements, promoter control elements, protein binding sequences, 5' and 3' untranslated regions, transcriptional start sites, termination sequences, polyadenylation sequences, and introns.

A "promoter" as used herein, refers to a nucleotide sequence that is capable of controlling the expression of a coding sequence or gene. Promoters are generally located 5' of the sequence that they regulate. Promoters may be derived in their entirety from a native gene, or be composed of different elements derived from promoters found in nature, and/or comprise synthetic nucleotide segments. Those skilled in the art will readily ascertain that different promoters may regulate expression of a coding sequence or gene in response to a particular stimulus, e.g., in a cell- or tissue-specific manner, in response to different environmental or physiological conditions, or in response to specific compounds. Prokaryotic promoters are typically classified into two classes: inducible and constitutive. A "constitutive promoter" refers to a promoter that allows for continual transcription of the coding sequence or gene under its control.

"Constitutive promoter" refers to a promoter that is capable of facilitating continuous transcription of a coding sequence or gene under its control and/or to which it is operably linked. Constitutive promoters and variants are well known in the art and include, but are not limited to, Ptac promoter, BBa_J23100, a constitutive *Escherichia coli* σS promoter (e.g., an osmY promoter (International Genetically Engineered Machine (iGEM) Registry of Standard Biological Parts Name BBa_J45992; BBa_J45993)), a constitutive *Escherichia coli* σ32 promoter (e.g., htpG heat shock promoter (BBa_J45504)), a constitutive *Escherichia coli* σ70 promoter (e.g., lacq promoter (BBa_J54200; BBa_J56015), *E. coli* CreABCD phosphate sensing operon promoter (BBa_J64951), GlnRS promoter (BBa_K088007), lacZ promoter (BBa_K119000; BBa_K119001); M13K07 gene I promoter (BBa_M13101); M13K07 gene II promoter (BBa_M13102), M13K07 gene III promoter (BBa_M13103), M13K07 gene IV promoter (BBa_M13104), M13K07 gene V promoter (BBa_M13105), M13K07 gene VI promoter (BBa_M13106), M13K07 gene VIII promoter (BBa_M13108), M13110 (BBa_M13110)), a constitutive *Bacillus subtilis* σA promoter (e.g., promoter veg (BBa_K143013), promoter 43 (BBa_K143013), PliaG (BBa_K823000), PlepA (BBa_K823002), Pveg (BBa_K823003)), a constitutive *Bacillus subtilis* σB promoter (e.g., promoter ctc (BBa_K143010), promoter gsiB (BBa_K143011)), a *Salmonella* promoter (e.g., Pspv2 from *Salmonella* (BBa_K112706), Pspv from *Salmonella* (BBa_K112707)), a bacteriophage T7 promoter (e.g., T7 promoter (BBa_I712074; BBa_I719005; BBa_J34814; BBa_J64997; BBa_K113010; BBa_K113011; BBa_K113012; BBa_R0085; BBa_R0180; BBa_R0181; BBa_R0182; BBa_R0183; BBa_Z0251; BBa_Z0252; BBa_Z0253)), and a bacteriophage SP6 promoter (e.g., SP6 promoter (BBa_J64998)).

An "inducible promoter" refers to a regulatory region that is operably linked to one or more genes, wherein expression of the gene(s) is increased in the presence of an inducer of said regulatory region. An "inducible promoter" refers to a promoter that initiates increased levels of transcription of the coding sequence or gene under its control in response to a stimulus or an exogenous environmental condition. A "directly inducible promoter" refers to a regulatory region, wherein the regulatory region is operably linked to a gene encoding a protein or polypeptide, where, in the presence of an inducer of said regulatory region, the protein or polypeptide is expressed. An "indirectly inducible promoter" refers to a regulatory system comprising two or more regulatory regions, for example, a first regulatory region that is operably linked to a first gene encoding a first protein, polypeptide, or factor, e.g., a transcriptional regulator, which is capable of regulating a second regulatory region that is operably linked to a second gene, the second regulatory region may be activated or repressed, thereby activating or repressing expression of the second gene. Both a directly inducible promoter and an indirectly inducible promoter are encompassed by "inducible promoter." Exemplary inducible promoters described herein include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline. Examples of inducible promoters include, but are not limited to, an FNR responsive promoter, a ParaC promoter, a ParaBAD promoter, and a PTetR promoter, each of which are described in more detail herein. Examples of other inducible promoters are provided herein below.

As used herein, "stably maintained" or "stable" bacterium is used to refer to a bacterial host cell carrying non-native genetic material, e.g., a gene encoding one or more anti-inflammation and/or gut barrier enhancer molecule(s), which is incorporated into the host genome or propagated on a self-replicating extra-chromosomal plasmid, such that the non-native genetic material is retained, expressed, and propagated. The stable bacterium is capable of survival and/or growth in vitro, e.g., in medium, and/or in vivo, e.g., in the gut. For example, the stable bacterium may be a genetically engineered bacterium comprising a gene encoding a encoding a payload, e.g., one or more anti-inflammation and/or gut barrier enhancer molecule(s), in which the plasmid or chromosome carrying the gene is stably maintained in the bacterium, such that the payload can be expressed in the bacterium, and the bacterium is capable of survival and/or growth in vitro and/or in vivo. In some embodiments, copy number affects the stability of expression of the non-native genetic material. In some embodiments, copy number affects the level of expression of the non-native genetic material.

As used herein, the term "expression" refers to the transcription and stable accumulation of sense (mRNA) or anti-sense RNA derived from a nucleic acid, and/or to translation of an mRNA into a polypeptide.

As used herein, the term "plasmid" or "vector" refers to an extrachromosomal nucleic acid, e.g., DNA, construct that is not integrated into a bacterial cell's genome. Plasmids are usually circular and capable of autonomous replication. Plasmids may be low-copy, medium-copy, or high-copy, as is well known in the art. Plasmids may optionally comprise a selectable marker, such as an antibiotic resistance gene, which helps select for bacterial cells containing the plasmid and which ensures that the plasmid is retained in the bacterial cell. A plasmid disclosed herein may comprise a nucleic acid sequence encoding a heterologous gene, e.g., a gene encoding an anti-inflammatory or gut barrier enhancer molecule.

As used herein, the term "transform" or "transformation" refers to the transfer of a nucleic acid fragment into a host bacterial cell, resulting in genetically-stable inheritance. Host bacterial cells comprising the transformed nucleic acid fragment are referred to as "recombinant" or "transgenic" or "transformed" organisms.

The term "genetic modification," as used herein, refers to any genetic change. Exemplary genetic modifications include those that increase, decrease, or abolish the expression of a gene, including, for example, modifications of native chromosomal or extrachromosomal genetic material. Exemplary genetic modifications also include the introduction of at least one plasmid, modification, mutation, base deletion, base addition, base substitution, and/or codon modification of chromosomal or extrachromosomal genetic sequence(s), gene over-expression, gene amplification, gene suppression, promoter modification or substitution, gene addition (either single or multi-copy), antisense expression or suppression, or any other change to the genetic elements of a host cell, whether the change produces a change in phenotype or not. Genetic modification can include the introduction of a plasmid, e.g., a plasmid comprising an anti-inflammatory or gut barrier enhancer molecule operably linked to a promoter, into a bacterial cell. Genetic modification can also involve a targeted replacement in the chromosome, e.g., to replace a native gene promoter with an inducible promoter, regulated promoter, strong promoter, or constitutive promoter. Genetic modification can also involve gene amplification, e.g., introduction of at least one additional copy of a native gene into the chromosome of the cell. Alternatively, chromosomal genetic modification can involve a genetic mutation.

As used herein, the term "genetic mutation" refers to a change or changes in a nucleotide sequence of a gene or related regulatory region that alters the nucleotide sequence as compared to its native or wild-type sequence. Mutations include, for example, substitutions, additions, and deletions, in whole or in part, within the wild-type sequence. Such substitutions, additions, or deletions can be single nucleotide changes (e.g., one or more point mutations), or can be two or more nucleotide changes, which may result in substantial changes to the sequence. Mutations can occur within the coding region of the gene as well as within the non-coding and regulatory sequence of the gene. The term "genetic mutation" is intended to include silent and conservative mutations within a coding region as well as changes which alter the amino acid sequence of the polypeptide encoded by the gene. A genetic mutation in a gene coding sequence may, for example, increase, decrease, or otherwise alter the activity (e.g., enzymatic activity) of the gene's polypeptide product. A genetic mutation in a regulatory sequence may increase, decrease, or otherwise alter the expression of sequences operably linked to the altered regulatory sequence.

As used herein, the term "transporter" is meant to refer to a mechanism, e.g., protein, proteins, or protein complex, for importing a molecule, e.g., amino acid, peptide (di-peptide, tri-peptide, polypeptide, etc), toxin, metabolite, substrate, as well as other biomolecules into the microorganism from the extracellular milieu.

As used herein, the phrase "exogenous environmental condition" or "exogenous environment signal" refers to settings, circumstances, stimuli, or biological molecules under which a promoter described herein is directly or indirectly induced. The phrase "exogenous environmental conditions" is meant to refer to the environmental conditions external to the engineered micororganism, but endogenous or native to the host subject environment. Thus, "exogenous" and "endogenous" may be used interchangeably to refer to environmental conditions in which the environmental conditions are endogenous to a mammalian body, but external or exogenous to an intact microorganism cell. In some embodiments, the exogenous environmental conditions are specific to the gut of a mammal. In some embodiments, the exogenous environmental conditions are specific to the upper gastrointestinal tract of a mammal. In some embodiments, the exogenous environmental conditions are specific to the lower gastrointestinal tract of a mammal. In some embodiments, the exogenous environmental conditions are specific to the small intestine of a mammal. In some embodiments, the exogenous environmental conditions are low-oxygen, microaerobic, or anaerobic conditions, such as the environment of the mammalian gut. In some embodiments, exogenous environmental conditions are molecules or metabolites that are specific to the mammalian gut, e.g., propionate. In some embodiments, the exogenous environmental condition is a tissue-specific or disease-specific metabolite or molecule(s). In some embodiments, the exogenous environmental condition is specific to an inflammatory disease. In some embodiments, the exogenous environmental condition is a low-pH environment. In some embodiments, the genetically engineered microorganism of the disclosure comprises a pH-dependent promoter. In some embodiments, the genetically engineered microorganism of the disclosure comprise an oxygen level-dependent promoter. In some aspects, bacteria have evolved transcription factors that are capable of sensing oxygen levels. Different signaling pathways may be triggered by different oxygen levels and occur with different kinetics. An "oxygen level-dependent promoter" or "oxygen level-dependent regulatory region" refers to a nucleic acid sequence to which one or more oxygen level-sensing transcription factors is capable of binding, wherein the binding and/or activation of the corresponding transcription factor activates downstream gene expression.

Examples of oxygen level-dependent transcription factors include, but are not limited to, FNR (fumarate and nitrate reductase), ANR, and DNR. Corresponding FNR-responsive promoters, ANR (anaerobic nitrate respiration)-responsive promoters, and DNR (dissimilatory nitrate respiration regulator)-responsive promoters are known in the art (see, e.g., Castiglione et al., 2009; Eiglmeier et al., 1989; Galimand et al., 1991; Hasegawa et al., 1998; Hoeren et al., 1993; Salmon et al., 2003), and non-limiting examples are shown in Table 1.

In a non-limiting example, a promoter (PfnrS) was derived from the *E. coli* Nissle fumarate and nitrate reductase gene S (fnrS) that is known to be highly expressed under conditions of low or no environmental oxygen (Durand and Storz, 2010; Boysen et al, 2010). The PfnrS promoter is activated under anaerobic conditions by the global transcriptional regulator FNR that is naturally found in Nissle. Under anaerobic conditions, FNR forms a dimer and binds to specific sequences in the promoters of specific genes under its control, thereby activating their expression. However, under aerobic conditions, oxygen reacts with iron-sulfur clusters in FNR dimers and converts them to an inactive form. In this way, the PfnrS inducible promoter is adopted to modulate the expression of proteins or RNA. PfnrS is used interchangeably in this application as FNRS, fnrs, FNR, P-FNRS promoter and other such related designations to indicate the promoter PfnrS.

TABLE 1

Examples of transcription factors and responsive genes and regulatory regions

| Transcription Factor | Examples of responsive genes, promoters, and/or regulatory regions: |
| --- | --- |
| FNR | nirB, ydfZ, pdhR, focA, ndH, hlyE, narK, narX, narG, yfiD, tdcD |
| ANR | arcDABC |
| DNR | norb, norC |

As used herein, a "tunable regulatory region" refers to a nucleic acid sequence under direct or indirect control of a transcription factor and which is capable of activating, repressing, derepressing, or otherwise controlling gene expression relative to levels of an inducer. In some embodiments, the tunable regulatory region comprises a promoter sequence. The inducer may be RNS, or other inducer described herein, and the tunable regulatory region may be a RNS-responsive regulatory region or other responsive regulatory region described herein. The tunable regulatory region may be operatively linked to a gene sequence(s) or gene cassette for the production of one or more payloads, e.g., a butyrogenic or other gene cassette or gene sequence(s). For example, in one specific embodiment, the tunable regulatory region is a RNS-derepressible regulatory region, and when RNS is present, a RNS-sensing transcription factor no longer binds to and/or represses the regulatory region, thereby permitting expression of the operatively linked gene or gene cassette. In this instance, the tunable regulatory region derepresses gene or gene cassette expression relative to RNS levels. Each gene or gene cassette may be operatively linked to a tunable regulatory region that is directly or indirectly controlled by a transcription factor that is capable of sensing at least one RNS.

In some embodiments, the exogenous environmental conditions are the presence or absence of reactive oxygen species (ROS). In other embodiments, the exogenous environmental conditions are the presence or absence of reactive nitrogen species (RNS). In some embodiments, exogenous environmental conditions are biological molecules that are involved in the inflammatory response, for example, molecules present in an inflammatory disorder of the gut. In some embodiments, the exogenous environmental conditions or signals exist naturally or are naturally absent in the environment in which the recombinant bacterial cell resides. In some embodiments, the exogenous environmental conditions or signals are artificially created, for example, by the creation or removal of biological conditions and/or the administration or removal of biological molecules.

In some embodiments, the exogenous environmental condition(s) and/or signal(s) stimulates the activity of an inducible promoter. In some embodiments, the exogenous environmental condition(s) and/or signal(s) that serves to activate the inducible promoter is not naturally present within the gut of a mammal. In some embodiments, the inducible promoter is stimulated by a molecule or metabolite that is administered in combination with the pharmaceutical composition of the disclosure, for example, tetracycline, arabinose, or any biological molecule that serves to activate an inducible promoter. In some embodiments, the exogenous environmental condition(s) and/or signal(s) is added to culture media comprising a recombinant bacterial cell of the disclosure. In some embodiments, the exogenous environmental condition that serves to activate the inducible promoter is naturally present within the gut of a mammal (for example, low oxygen or anaerobic conditions, or biological molecules involved in an inflammatory response). In some embodiments, the loss of exposure to an exogenous environmental condition (for example, in vivo) inhibits the activity of an inducible promoter, as the exogenous environmental condition is not present to induce the promoter (for example, an aerobic environment outside the gut).

"Gut" refers to the organs, glands, tracts, and systems that are responsible for the transfer and digestion of food, absorption of nutrients, and excretion of waste. In humans, the gut comprises the gastrointestinal (GI) tract, which starts at the mouth and ends at the anus, and additionally comprises the esophagus, stomach, small intestine, and large intestine. The gut also comprises accessory organs and glands, such as the spleen, liver, gallbladder, and pancreas. The upper gastrointestinal tract comprises the esophagus, stomach, and duodenum of the small intestine. The lower gastrointestinal tract comprises the remainder of the small intestine, i.e., the jejunum and ileum, and all of the large intestine, i.e., the cecum, colon, rectum, and anal canal. Bacteria can be found throughout the gut, e.g., in the gastrointestinal tract, and particularly in the intestines.

"Microorganism" refers to an organism or microbe of microscopic, submicroscopic, or ultramicroscopic size that typically consists of a single cell. Examples of microorganisms include bacteria, viruses, parasites, fungi, certain algae, yeast, e.g., *Saccharomyces*, and protozoa. In some aspects, the microorganism is engineered ("engineered microorganism") to produce one or more therapeutic molecules, e.g., an antiinflammatory or barrier enhancer molecule. In certain embodiments, the engineered microorganism is an engineered bacterium. In certain embodiments, the engineered microorganism is an engineered virus.

"Non-pathogenic bacteria" refer to bacteria that are not capable of causing disease or harmful responses in a host. In some embodiments, non-pathogenic bacteria are Gram-negative bacteria. In some embodiments, non-pathogenic bacteria are Gram-positive bacteria. In some embodiments, non-pathogenic bacteria do not contain lipopolysaccharides (LPS). In some embodiments, non-pathogenic bacteria are commensal bacteria. Examples of non-pathogenic bacteria include, but are not limited to certain strains belonging to the genus *Bacillus, Bacteroides, Bifidobacterium, Brevibacteria, Clostridium, Enterococcus, Escherichia coli, Lactobacillus, Lactococcus, Saccharomyces,* and *Staphylococcus*, e.g., *Bacillus coagulans, Bacillus subtilis, Bacteroides fragilis, Bacteroides subtilis, Bacteroides thetaiotaomicron, Bifidobacterium bifidum, Bifidobacterium infantis, Bifidobacterium lactis, Bifidobacterium longum, Clostridium butyricum, Enterococcus faecium, Escherichia coli, Escherichia coli Nissle, Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis* and *Saccharomyces boulardii* (Sonnenborn et al., 2009; Dinleyici et al., 2014; U.S. Pat. Nos. 6,835,376; 6,203,797; 5,589,168; 7,731,976). Non-pathogenic bacteria also include commensal bacteria, which are present in the indigenous microbiota of the gut. In one embodiment, the disclosure further includes non-pathogenic *Saccharomyces*, such as *Saccharomyces boulardii*. Naturally pathogenic bacteria may be genetically engineered to reduce or eliminate pathogenicity.

"Probiotic" is used to refer to live, non-pathogenic microorganisms, e.g., bacteria, which can confer health benefits to a host organism that contains an appropriate amount of the microorganism. In some embodiments, the host organism is a mammal. In some embodiments, the host organism is a human. In some embodiments, the probiotic bacteria are Gram-negative bacteria. In some embodiments, the probiotic bacteria are Gram-positive bacteria. Some species, strains, and/or subtypes of non-pathogenic bacteria are currently recognized as probiotic bacteria. Examples of probiotic bacteria include, but are not limited to, certain strains belonging to the genus *Bifidobacteria, Escherichia Coli, Lactobacillus,* and *Saccharomyces* e.g., *Bifidobacterium bifidum, Enterococcus faecium, Escherichia coli* strain Nissle, *Lactobacillus acidophilus, Lactobacillus bulgaricus, Lactobacillus paracasei,* and *Lactobacillus plantarum*, and *Saccharomyces boulardii* (Dinleyici et al., 2014; U.S. Pat. Nos. 5,589,168; 6,203,797; 6,835,376). The probiotic may be a variant or a mutant strain of bacterium (Arthur et al., 2012; Cuevas-Ramos et al., 2010; Olier et al., 2012; Nougayrede et al., 2006). Non-pathogenic bacteria may be genetically engineered to enhance or improve desired biological properties, e.g., survivability. Non-pathogenic bacteria may be genetically engineered to provide probiotic properties. Probiotic bacteria may be genetically engineered to enhance or improve probiotic properties.

As used herein, the term "modulate" and its cognates means to alter, regulate, or adjust positively or negatively a molecular or physiological readout, outcome, or process, to effect a change in said readout, outcome, or process as compared to a normal, average, wild-type, or baseline measurement. Thus, for example, "modulate" or "modulation" includes up-regulation and down-regulation. A non-limiting example of modulating a readout, outcome, or process is effecting a change or alteration in the normal or baseline functioning, activity, expression, or secretion of a biomolecule (e.g. a protein, enzyme, cytokine, growth factor, hormone, metabolite, short chain fatty acid, or other compound). Another non-limiting example of modulating a readout, outcome, or process is effecting a change in the amount or level of a biomolecule of interest, e.g. in the serum and/or the gut lumen. In another non-limiting example, modulating a readout, outcome, or process relates to a phenotypic change or alteration in one or more disease symptoms. Thus, "modulate" is used to refer to an increase, decrease, masking, altering, overriding or restoring the normal functioning, activity, or levels of a readout, outcome or process (e.g, biomolecule of interest, and/or molecular or physiological process, and/or a phenotypic change in one or more disease symptoms).

As used herein, the term "auxotroph" or "auxotrophic" refers to an organism that requires a specific factor, e.g., an amino acid, a sugar, or other nutrient) to support its growth. An "auxotrophic modification" is a genetic modification that causes the organism to die in the absence of an exogenously added nutrient essential for survival or growth because it is unable to produce said nutrient. As used herein, the term "essential gene" refers to a gene which is necessary to for cell growth and/or survival. Essential genes are described in more detail infra and include, but are not limited to, DNA synthesis genes (such as thyA), cell wall synthesis genes (such as dapA), and amino acid genes (such as serA and metA).

As used herein, the terms "modulate" and "treat" a disease and their cognates refer to an amelioration of a disease, disorder, and/or condition, or at least one discernible symptom thereof. In another embodiment, "modulate" and "treat" refer to an amelioration of at least one measurable physical parameter, not necessarily discernible by the patient. In another embodiment, "modulate" and "treat" refer to inhibiting the progression of a disease, disorder, and/or condition, either physically (e.g., stabilization of a discernible symptom), physiologically (e.g., stabilization of a physical parameter), or both. In another embodiment, "modulate" and "treat" refer to slowing the progression or reversing the progression of a disease, disorder, and/or condition. As used herein, "prevent" and its cognates refer to delaying the onset or reducing the risk of acquiring a given disease, disorder and/or condition or a symptom associated with such disease, disorder, and/or condition.

Those in need of treatment may include individuals already having a particular medical disorder, as well as those at risk of having, or who may ultimately acquire the disorder. The need for treatment is assessed, for example, by the presence of one or more risk factors associated with the development of a disorder, the presence or progression of a disorder, or likely receptiveness to treatment of a subject having the disorder. Treating autoimmune disorders and/or diseases and conditions associated with gut inflammation and/or compromised gut barrier function may encompass reducing or eliminating excess inflammation and/or associated symptoms, and does not necessarily encompass the elimination of the underlying disease.

Treating the diseases described herein may encompass increasing levels of butyrate, increasing levels of acetate, increasing levels of butyrate and increasing GLP-2, IL-22, and/or IL-10, and/or modulating levels of tryptophan and/or its metabolites (e.g., kynurenine), and/or providing any other anti-inflammation and/or gut barrier enhancer molecule and does not necessarily encompass the elimination of the underlying disease.

As used herein a "pharmaceutical composition" refers to a preparation of genetically engineered microorganism of the disclosure, e.g., genetically engineered bacteria or virus, with other components such as a physiologically suitable carrier and/or excipient.

The phrases "physiologically acceptable carrier" and "pharmaceutically acceptable carrier" which may be used interchangeably refer to a carrier or a diluent that does not cause significant irritation to an organism and does not abrogate the biological activity and properties of the administered bacterial or viral compound. An adjuvant is included under these phrases.

The term "excipient" refers to an inert substance added to a pharmaceutical composition to further facilitate administration of an active ingredient. Examples include, but are not limited to, calcium bicarbonate, sodium bicarbonate calcium phosphate, various sugars and types of starch, cellulose derivatives, gelatin, vegetable oils, polyethylene glycols, and surfactants, including, for example, polysorbate 20.

The terms "therapeutically effective dose" and "therapeutically effective amount" are used to refer to an amount of a compound that results in prevention, delay of onset of symptoms, or amelioration of symptoms of a condition, e.g., inflammation, diarrhea an autoimmune disorder. A therapeutically effective amount may, for example, be sufficient to treat, prevent, reduce the severity, delay the onset, and/or reduce the risk of occurrence of one or more symptoms of an autoimmune a disorder and/or a disease or condition associated with gut inflammation and/or compromised gut barrier function. A therapeutically effective amount, as well as a therapeutically effective frequency of administration, can be determined by methods known in the art and discussed below.

As used herein, the term "bacteriostatic" or "cytostatic" refers to a molecule or protein which is capable of arresting, retarding, or inhibiting the growth, division, multiplication or replication of recombinant bacterial cell of the disclosure.

As used herein, the term "bactericidal" refers to a molecule or protein which is capable of killing the recombinant bacterial cell of the disclosure.

As used herein, the term "toxin" refers to a protein, enzyme, or polypeptide fragment thereof, or other molecule which is capable of arresting, retarding, or inhibiting the growth, division, multiplication or replication of the recombinant bacterial cell of the disclosure, or which is capable of killing the recombinant bacterial cell of the disclosure. The term "toxin" is intended to include bacteriostatic proteins and bactericidal proteins. The term "toxin" is intended to include, but not limited to, lytic proteins, bacteriocins (e.g., microcins and colicins), gyrase inhibitors, polymerase inhibitors, transcription inhibitors, translation inhibitors, DNases, and RNases. The term "anti-toxin" or "antitoxin," as used herein, refers to a protein or enzyme which is capable of inhibiting the activity of a toxin. The term anti-toxin is intended to include, but not limited to, immunity modulators, and inhibitors of toxin expression. Examples of toxins and antitoxins are known in the art and described in more detail infra.

As used herein, "payload" refers to one or more molecules of interest to be produced by a genetically engineered microorganism, such as a bacteria or a virus. In some embodiments, the payload is a therapeutic payload, e.g. and antiinflammatory or gut barrier enhancer molecule, e.g. butyrate, acetate, propionate, GLP-2, IL-10, IL-22, IL-2, other interleukins, and/or tryptophan and/or one or more of its metabolites. In some embodiments, the payload is a regulatory molecule, e.g., a transcriptional regulator such as FNR. In some embodiments, the payload comprises a regulatory element, such as a promoter or a repressor. In some embodiments, the payload comprises an inducible promoter, such as from FNRS. In some embodiments the payload comprises a repressor element, such as a kill switch. In some embodiments the payload comprises an antibiotic resistance gene or genes. In some embodiments, the payload is encoded by a gene, multiple genes, gene cassette, or an operon. In alternate embodiments, the payload is produced by a biosynthetic or biochemical pathway, wherein the biosynthetic or biochemical pathway may optionally be endogenous to the microorganism. In alternate embodiments, the payload is produced by a biosynthetic or biochemical pathway, wherein the biosynthetic or biochemical pathway is not endogenous to the microorganism. In some embodiments, the genetically engineered microorganism comprises two or more payloads.

As used herein, the term "conventional treatment" or "conventional therapy" refers to treatment or therapy that is currently accepted, considered current standard of care, and/or used by most healthcare professionals for treating a disease or disorder associated with BCAA. It is different from alternative or complementary therapies, which are not as widely used.

As used herein, the term "polypeptide" includes "polypeptide" as well as "polypeptides," and refers to a molecule composed of amino acid monomers linearly linked by amide bonds (i.e., peptide bonds). The term "polypeptide" refers to any chain or chains of two or more amino acids, and does not refer to a specific length of the product. Thus, "peptides," "dipeptides," "tripeptides," "oligopeptides," "protein," "amino acid chain," or any other term used to refer to a chain or chains of two or more amino acids, are included within the definition of "polypeptide," and the term "polypeptide" may be used instead of, or interchangeably with any of these terms. The term "polypeptide" is also intended to refer to the products of post-expression modifications of the polypeptide, including but not limited to glycosylation, acetylation, phosphorylation, amidation, derivatization, proteolytic cleavage, or modification by non-naturally occurring amino acids. A polypeptide may be derived from a natural biological source or produced by recombinant technology. In other embodiments, the polypeptide is produced by the genetically engineered bacteria or virus of the current invention. A polypeptide of the invention may be of a size of about 3 or more, 5 or more, 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides, which do not possess a defined three-dimensional structure, but rather can adopt a large number of different conformations, are referred to as unfolded. The term "peptide" or "polypeptide" may refer to an amino acid sequence that corresponds to a protein or a portion of a protein or may refer to an amino acid sequence that corresponds with non-protein sequence, e.g., a sequence selected from a regulatory peptide sequence, leader peptide sequence, signal peptide sequence, linker peptide sequence, and other peptide sequence.

An "isolated" polypeptide or a fragment, variant, or derivative thereof refers to a polypeptide that is not in its natural milieu. No particular level of purification is required. Recombinantly produced polypeptides and proteins expressed in host cells, including but not limited to bacterial or mammalian cells, are considered isolated for purposed of the invention, as are native or recombinant polypeptides which have been separated, fractionated, or partially or substantially purified by any suitable technique. Recombinant peptides, polypeptides or proteins refer to peptides, polypeptides or proteins produced by recombinant DNA techniques, i.e. produced from cells, microbial or mammalian, transformed by an exogenous recombinant DNA expression construct encoding the polypeptide. Proteins or peptides expressed in most bacterial cultures will typically be free of glycan. Fragments, derivatives, analogs or variants of the foregoing polypeptides, and any combination thereof are also included as polypeptides. The terms "fragment," "variant," "derivative" and "analog" include polypeptides having an amino acid sequence sufficiently similar to the amino acid sequence of the original peptide and include any polypeptides, which retain at least one or more properties of the corresponding original polypeptide. Fragments of polypeptides of the present invention include proteolytic fragments, as well as deletion fragments. Fragments also include specific antibody or bioactive fragments or immunologically active fragments derived from any polypeptides described herein. Variants may occur naturally or be non-naturally occurring. Non-naturally occurring variants may be produced using mutagenesis methods known in the art. Variant polypeptides may comprise conservative or non-conservative amino acid substitutions, deletions or additions.

Polypeptides also include fusion proteins. As used herein, the term "variant" includes a fusion protein, which comprises a sequence of the original peptide or sufficiently similar to the original peptide. As used herein, the term "fusion protein" refers to a chimeric protein comprising amino acid sequences of two or more different proteins. Typically, fusion proteins result from well known in vitro recombination techniques. Fusion proteins may have a similar structural function (but not necessarily to the same extent), and/or similar regulatory function (but not necessarily to the same extent), and/or similar biochemical function (but not necessarily to the same extent) and/or immunological activity (but not necessarily to the same extent) as the individual original proteins which are the components of the fusion proteins. "Derivatives" include but are not limited to peptides, which contain one or more naturally occurring amino acid derivatives of the twenty standard amino acids. "Similarity" between two peptides is determined by comparing the amino acid sequence of one peptide to the sequence of a second peptide. An amino acid of one peptide is similar to the corresponding amino acid of a second peptide if it is identical or a conservative amino acid substitution. Conservative substitutions include those described in Dayhoff, M. O., ed., The Atlas of Protein Sequence and Structure 5, National Biomedical Research Foundation, Washington, D.C. (1978), and in Argos, EMBO J. 8 (1989), 779-785. For example, amino acids belonging to one of the following groups represent conservative changes or substitutions: -Ala, Pro, Gly, Gln, Asn, Ser, Thr; -Cys, Ser, Tyr, Thr; -Val, Ile, Leu, Met, Ala, Phe; -Lys, Arg, His; -Phe, Tyr, Trp, His; and -Asp, Glu.

An antibody generally refers to a polypeptide of the immunoglobulin family or a polypeptide comprising fragments of an immunoglobulin that is capable of noncovalently, reversibly, and in a specific manner binding a corresponding antigen. An exemplary antibody structural unit comprises a tetramer. Each tetramer is composed of two identical pairs of polypeptide chains, each pair having one "light" (about 25 kD) and one "heavy" chain (about 50-70 kD), connected through a disulfide bond. The recognized immunoglobulin genes include the κ, λ, α, γ, δ, ε, and μ constant region genes, as well as the myriad immunoglobulin variable region genes. Light chains are classified as either κ or λ. Heavy chains are classified as γ, μ, α, δ, or ε, which in turn define the immunoglobulin classes, IgG, IgM, IgA, IgD, and IgE, respectively. The N-terminus of each chain defines a variable region of about 100 to 110 or more amino acids primarily responsible for antigen recognition. The terms variable light chain (VL) and variable heavy chain (VH) refer to these regions of light and heavy chains respectively.

As used herein, the term "antibody" or "antibodies" is meant to encompasses all variations of antibody and fragments thereof that possess one or more particular binding specificities. Thus, the term "antibody" or "antibodies" is meant to include full length antibodies, chimeric antibodies, humanized antibodies, single chain antibodies (ScFv, camelids), Fab, Fab', multimeric versions of these fragments (e.g., F(ab')2), single domain antibodies (sdAB, VHH framents), heavy chain antibodies (HCAb), nanobodies, diabodies, and minibodies. Antibodies can have more than one binding specificity, e.g., be bispecific. The term "antibody" is also meant to include so-called antibody mimetics. Antibody mimetics refers to small molecules, e.g., 3-30 kDa, which can be single amino acid chain molecules, which can specifically bind antigens but do not have an antibody-related structure. Antibody mimetics, include, but are not limited to, Affibody molecules (Z domain of Protein A), Affitins (Gamma-B crystalline), Ubiquitin, Affimers (Cystatin), Affitins (Sac7d from *Sulfolobus acidocaldarius*), Alphabodies (Triple helix coiled coil), Anticalins (Lipocalins), Avimers (domains of various membrane receptors), DARPins (Ankyrin repeat motif), Fynomers (SH3 domain of Fyn), Kunitz domain peptides Kunitz domains of various protease inhibitors), Ecallantide (Kalbitor), and Monobodies. In certain aspects, the term "antibody" or "antibodies" is meant to refer to a single chain antibody(ies), single domain antibody(ies), and camelid antibody(ies). Utility of antibodies in the treatment of cancer and additional anti cancer antibodies can for example be found in Scott et al., Antibody Therapy for Cancer, Nature Reviews Cancer April 2012 Volume 12, incorporated by reference in its entirety.

A "single-chain antibody" or "single-chain antibodies" typically refers to a peptide comprising a heavy chain of an immunoglobulin, a light chain of an immunoglobulin, and optionally a linker or bond, such as a disulfide bond. The single-chain antibody lacks the constant Fc region found in traditional antibodies. In some embodiments, the single-chain antibody is a naturally occurring single-chain antibody, e.g., a camelid antibody. In some embodiments, the single-chain antibody is a synthetic, engineered, or modified single-chain antibody. In some embodiments, the single-chain antibody is capable of retaining substantially the same antigen specificity as compared to the original immunoglobulin despite the addition of a linker and the removal of the constant regions. In some aspects, the single chain antibody can be a "scFv antibody", which refers to a fusion protein of the variable regions of the heavy (VH) and light chains (VL) of immunoglobulins (without any constant regions), optionally connected with a short linker peptide of ten to about 25 amino acids, as described, for example, in U.S. Pat. No. 4,946,778, the contents of which is herein incorporated by reference in its entirety. The Fv fragment is the smallest fragment that holds a binding site of an antibody, which binding site may, in some aspects, maintain the specificity of the original antibody. Techniques for the production of single chain antibodies are described in U.S. Pat. No. 4,946,778. The VH and VL sequences of the scFv can be connected via the N-terminus of the VH connecting to the C-terminus of the VL or via the C-terminus of the VH connecting to the N-terminus of the VL. ScFv fragments are independent folding entities that can be fused indistinctively on either end to other epitope tags or protein domains. Linkers of varying length can be used to link the VH and VL sequences, which the linkers can be glycine rich (provides flexibility) and serine or threonine rich (increases solubility). Short linkers may prevent association of the two domains and can result in multimers (diabodies, tribodies, etc.). Long linkers may result in proteolysis or weak domain association (described in Voelkel et al el., 2011). Linkers of length between 15 and 20 amino acids or 18 and 20 amino acids are most often used. Additional non-limiting examples of linkers, including other flexible linkers are described in Chen et al., 2013 (Adv Drug Deliv Rev. 2013 Oct. 15; 65(10): 1357-1369. Fusion Protein Linkers: Property, Design and Functionality), the contents of which is herein incorporated by reference in its entirety. Flexible linkers are also rich in small or polar amino acids such as Glycine and Serine, but can contain additional amino acids such as Threonine and Alanine to maintain flexibility, as well as polar amino acids such as Lysine and Glutamate to improve solubility. Exemplary linkers include, but are not limited to, (Gly-Gly-Gly-Gly-Ser)n (SEQ ID NO: 284), KESGSVSSEQLAQFRSLD. (SEQ ID NO: 285) and EGKSSGSGSESKST (SEQ ID NO: 286), (Gly)8 (SEQ ID NO: 287), and Gly and Ser rich flexible linker, GSAGSAAGSGEF(SEQ ID NO: 288). "Single chain antibodies" as used herein also include single-domain antibodies, which include camelid antibodies and other heavy chain antibodies, light chain antibodies, including nanobodies and single domains VH or VL domains derived from human, mouse or other species. Single domain antibodies may be derived from any species including, but not limited to mouse, human, camel, llama, fish, shark, goat, rabbit, and bovine. Single domain antibodies include domain antigen-binding units which have a camelid scaffold, derived from camels, llamas, or alpacas. Camelids produce functional antibodies devoid of light chains. The heavy chain variable (VH) domain folds autonomously and functions independently as an antigen-binding unit. Its binding surface involves only three CDRs as compared to the six CDRs in classical antigen-binding molecules (Fabs) or single chain variable fragments (scFvs). Camelid antibodies are capable of attaining binding affinities comparable to those of conventional antibodies. Camelid scaffold-based antibodies can be produced using methods well known in the art. Cartilaginous fishes also have heavy-chain antibodies (IgNAR, 'immunoglobulin new antigen receptor'), from which single-domain antibodies called VNAR fragments can be obtained. Alternatively, the dimeric variable domains from IgG from humans or mice can be split into monomers. Nanobodies are single chain antibodies derived from light chains. The term "single chain antibody" also refers to antibody mimetics.

In some embodiments, the antibodies expressed by the engineered microorganisms are bispecific. In certain embodiments, a bispecific antibody molecule comprises a scFv, or fragment thereof, have binding specificity for a first epitope and a scFv, or fragment thereof, have binding specificity for a second epitope. Antigen-binding fragments or antibody portions include bivalent scFv (diabody), bispecific scFv antibodies where the antibody molecule recognizes two different epitopes, single binding domains (dAbs), and minibodies. Monomeric single-chain diabodies (scDb) are readily assembled in bacterial and mammalian cells and show improved stability under physiological conditions (Voelkel et al., 2001 and references therein; Protein Eng. (2001) 14 (10): 815-823 (describes optimized linker sequences for the expression of monomeric and dimeric bispecific single-chain diabodies).

As used herein, the term "sufficiently similar" means a first amino acid sequence that contains a sufficient or minimum number of identical or equivalent amino acid residues relative to a second amino acid sequence such that the first and second amino acid sequences have a common structural domain and/or common functional activity. For example, amino acid sequences that comprise a common structural domain that is at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100%, identical are defined herein as sufficiently similar. Preferably, variants will be sufficiently similar to the amino acid sequence of the peptides of the invention. Such variants generally retain the functional activity of the peptides of the present invention. Variants include peptides that differ in amino acid sequence from the native and wt peptide, respectively, by way of one or more amino acid deletion(s), addition(s), and/or substitution(s). These may be naturally occurring variants as well as artificially designed ones.

As used herein the term "linker", "linker peptide" or "peptide linkers" or "linker" refers to synthetic or non-native or non-naturally-occurring amino acid sequences that connect or link two polypeptide sequences, e.g., that link two polypeptide domains. As used herein the term "synthetic" refers to amino acid sequences that are not naturally occurring. Exemplary linkers are described herein. Additional exemplary linkers are provided in US 20140079701, the contents of which are herein incorporated by reference in its entirety.

As used herein the term "codon-optimized" refers to the modification of codons in the gene or coding regions of a nucleic acid molecule to reflect the typical codon usage of the host organism without altering the polypeptide encoded by the nucleic acid molecule. Such optimization includes replacing at least one, or more than one, or a significant number, of codons with one or more codons that are more frequently used in the genes of the host organism. A "codon-optimized sequence" refers to a sequence, which was modified from an existing coding sequence, or designed, for example, to improve translation in an expression host cell or organism of a transcript RNA molecule transcribed from the coding sequence, or to improve transcription of a coding sequence. Codon optimization includes, but is not limited to, processes including selecting codons for the coding sequence to suit the codon preference of the expression host organism. Many organisms display a bias or preference for use of particular codons to code for insertion of a particular amino acid in a growing polypeptide chain. Codon preference or codon bias, differences in codon usage between organisms, is allowed by the degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

As used herein, the terms "secretion system" or "secretion protein" refers to a native or non-native secretion mechanism capable of secreting or exporting a biomolecule, e.g., polypeptide from the microbial, e.g., bacterial cytoplasm. The secretion system may comprise a single protein or may comprise two or more proteins assembled in a complex e.g., HlyBD. Non-limiting examples of secretion systems for gram negative bacteria include the modified type III flagellar, type I (e.g., hemolysin secretion system), type II, type IV, type V, type VI, and type VII secretion systems, resistance-nodulation-division (RND) multi-drug efflux pumps, various single membrane secretion systems. Non-liming examples of secretion systems for gram positive bacteria include Sec and TAT secretion systems. In some embodiments, the polypeptide to be secreted include a "secretion tag" of either RNA or peptide origin to direct the polypeptide to specific secretion systems. In some embodiments, the secretion system is able to remove this tag before secreting the polypeptide from the engineered bacteria. For example, in Type V auto-secretion-mediated secretion the N-terminal peptide secretion tag is removed upon translocation of the "passenger" peptide from the cytoplasm into the periplasmic compartment by the native Sec system. Further, once the auto-secretor is translocated across the outer membrane the C-terminal secretion tag can be removed by either an autocatalytic or protease-catalyzed e.g., OmpT cleavage thereby releasing the antiinflammatory or barrier enhancer molecule(s) into the extracellular milieu. In some embodiments, the secretion system involves the generation of a "leaky" or de-stabilized outer membrane, which may be accomplished by deleting or mutagenizing genes responsible for tethering the outer membrane to the rigid peptidoglycan skeleton, including for example, lpp, ompC, ompA, ompF, tolA, tolB, pal, degS, degP, and nlp1. Lpp functions as the primary 'staple' of the bacterial cell wall to the peptidoglycan. TolA-PAL and OmpA complexes function similarly to Lpp and are other deletion targets to generate a leaky phenotype. Additionally, leaky phenotypes have been observed when periplasmic proteases, such as degS, degP or nlpI, are deactivated. Thus, in some embodiments, the engineered bacteria have one or more deleted or mutated membrane genes, e.g., selected from lpp, ompA, ompA, ompF, tolA, tolB, and pal genes. In some embodiments, the engineered bacteria have one or more deleted or mutated periplasmic protease genes, e.g., selected from degS, degP, and nlp1. In some embodiments, the engineered bacteria have one or more deleted or mutated gene(s), selected from lpp, ompA, ompA, ompF, tolA, tolB, pal, degS, degP, and nlp1 genes.

The articles "a" and "an," as used herein, should be understood to mean "at least one," unless clearly indicated to the contrary.

The phrase "and/or," when used between elements in a list, is intended to mean either (1) that only a single listed element is present, or (2) that more than one element of the list is present. For example, "A, B, and/or C" indicates that the selection may be A alone; B alone; C alone; A and B; A and C; B and C; or A, B, and C. The phrase "and/or" may be used interchangeably with "at least one of" or "one or more of" the elements in a list.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Bacteria

The genetically engineered microorganisms, or programmed microorganisms, such as genetically engineered bacteria of the disclosure are capable of producing one or more non-native anti-inflammation and/or gut barrier function enhancer molecules. In certain embodiments, the genetically engineered bacteria are obligate anaerobic bacteria. In certain embodiments, the genetically engineered bacteria are facultative anaerobic bacteria. In certain embodiments, the genetically engineered bacteria are aerobic bacteria. In some embodiments, the genetically engineered bacteria are Gram-positive bacteria. In some embodiments, the genetically engineered bacteria are Gram-positive bacteria and lack LPS. In some embodiments, the genetically engineered bacteria are Gram-negative bacteria. In some embodiments, the genetically engineered bacteria are Gram-positive and obligate anaerobic bacteria. In some embodiments, the genetically engineered bacteria are Gram-positive and facultative anaerobic bacteria. In some embodiments, the genetically engineered bacteria are non-pathogenic bacteria. In some embodiments, the genetically engineered bacteria are commensal bacteria. In some embodiments, the genetically engineered bacteria are probiotic bacteria. In some embodiments, the genetically engineered bacteria are naturally pathogenic bacteria that are modified or mutated to reduce or eliminate pathogenicity. Exemplary bacteria include, but are not limited to, *Bacillus*, *Bacteroides*, *Bifidobacterium*, *Brevibacteria*, *Caulobacter*, *Clostridium*, *Enterococcus*, *Escherichia coli*, *Lactobacillus*, *Lactococcus*, *Listeria*, *Mycobacterium*, *Saccharomyces*, *Salmonella*, *Staphylococcus*, *Streptococcus*, *Vibrio*, *Bacillus coagulans*, *Bacillus subtilis*, *Bacteroides fragilis*, *Bacteroides subtilis*, *Bacteroides thetaiotaomicron*, *Bifidobacterium adolescentis*, *Bifidobacterium bifidum*, *Bifidobacterium breve* UCC2003, *Bifidobacterium infantis*, *Bifidobacterium lactis*, *Bifidobacterium longum*, *Clostridium acetobutylicum*, *Clostridium butyricum*, *Clostridium butyricum* M-55, *Clostridium cochlearum*, *Clostridium felsineum*, *Clostridium histolyticum*, *Clostridium multifermentans*, *Clostridium novyi*-NT, *Clostridium paraputrificum*, *Clostridium pasteureanum*, *Clostridium pectinovorum*, *Clostridium perfringens*, *Clostridium roseum*, *Clostridium sporogenes*, *Clostridium tertium*, *Clostridium tetani*, *Clostridium tyrobutyricum*, *Corynebacterium parvum*, *Escherichia coli* MG1655, *Escherichia coli* Nissle 1917, *Listeria monocytogenes*, *Mycobacterium bovis*, *Salmonella choleraesuis*, *Salmonella typhimurium*, and *Vibrio cholera*. In certain embodiments, the genetically engineered bacteria are selected from the group consisting of *Enterococcus faecium*, *Lactobacillus acidophilus*, *Lactobacillus bulgaricus*, *Lactobacillus casei*, *Lactobacillus johnsonii*, *Lactobacillus paracasei*, *Lactobacillus plantarum*, *Lactobacillus reuteri*, *Lactobacillus rhamnosus*, *Lactococcus lactis*, and *Saccharomyces boulardii*, *Clostridium* clusters IV and XIVa of Firmicutes (including species of *Eubacterium*), *Roseburia*, *Faecalibacterium*, *Enterobacter*, *Faecalibacterium prausnitzii*, *Clostridium difficile*, *Subdoligranulum*, *Clostridium sporogenes*, *Campylobacter jejuni*, *Clostridium saccharolyticum*, *Klebsiella*, *Citrobacter*, *Pseudobutyrivibrio*, and *Ruminococcus*. In certain embodiments, the genetically engineered bacteria are selected from *Bacteroides fragilis*, *Bacteroides thetaiotaomicron*, *Bacteroides subtilis*, *Bifidobacterium bifidum*, *Bifidobacterium infantis*, *Bifidobacterium lactis*, *Clostridium butyricum*, *Escherichia coli*, *Escherichia coli* Nissle, *Lactobacillus acidophilus*, *Lactobacillus plantarum*, *Lactobacillus reuteri*, and *Lactococcus lactis*

In some embodiments, the genetically engineered bacterium is a Gram-positive bacterium, e.g., *Clostridium*, that is naturally capable of producing high levels of butyrate. In some embodiments, the genetically engineered bacterium is selected from the group consisting of *C. butyricum* ZJUCB, *C. butyricum* S21, *C. thermobutyricum* ATCC 49875, *C. beijerinckii*, *C. populeti* ATCC 35295, *C. tyrobutyricum* JM1, *C. tyrobutyricum* CIP 1-776, *C. tyrobutyricum* ATCC 25755, *C. tyrobutyricum* CNRZ 596, and *C. tyrobutyricum* ZJU 8235. In some embodiments, the genetically engineered bacterium is *C. butyricum* CBM588, a probiotic bacterium that is highly amenable to protein secretion and has demonstrated efficacy in treating IBD (Kanai et al., 2015). In some embodiments, the genetically engineered bacterium is *Bacillus*, a probiotic bacterium that is highly genetically tractable and has been a popular chassis for industrial protein production; in some embodiments, the bacterium has highly active secretion and/or no toxic byproducts (Cutting, 2011).

In one embodiment, the bacterial cell is a *Bacteroides fragilis* bacterial cell. In one embodiment, the bacterial cell is a *Bacteroides thetaiotaomicron* bacterial cell. In one embodiment, the bacterial cell is a *Bacteroides subtilis* bacterial cell. In one embodiment, the bacterial cell is a *Bifidobacterium bifidum* bacterial cell. In one embodiment, the bacterial cell is a *Bifidobacterium infantis* bacterial cell. In one embodiment, the bacterial cell is a *Bifidobacterium lactis* bacterial cell. In one embodiment, the bacterial cell is a *Clostridium butyricum* bacterial cell. In one embodiment, the bacterial cell is an *Escherichia coli* bacterial cell. In one embodiment, the bacterial cell is a *Lactobacillus acidophilus* bacterial cell. In one embodiment, the bacterial cell is a *Lactobacillus plantarum* bacterial cell. In one embodiment, the bacterial cell is a *Lactobacillus reuteri* bacterial cell. In one embodiment, the bacterial cell is a *Lactococcus lactis* bacterial cell.

In some embodiments, the genetically engineered bacteria are *Escherichia coli* strain Nissle 1917 (*E. coli* Nissle), a Gram-negative bacterium of the Enterobacteriaceae family that has evolved into one of the best characterized probiotics (Ukena et al., 2007). The strain is characterized by its complete harmlessness (Schultz, 2008), and has GRAS (generally recognized as safe) status (Reister et al., 2014, emphasis added). Genomic sequencing confirmed that *E. coli* Nissle lacks prominent virulence factors (e.g., *E. coli* α-hemolysin, P-fimbrial adhesins) (Schultz, 2008). In addition, it has been shown that *E. coli* Nissle does not carry pathogenic adhesion factors, does not produce any enterotoxins or cytotoxins, is not invasive, and not uropathogenic (Sonnenbom et al., 2009). As early as in 1917, *E. coli* Nissle was packaged into medicinal capsules, called Mutaflor, for therapeutic use. *E. coli* Nissle has since been used to treat ulcerative colitis in humans in vivo (Rembacken et al., 1999), to treat inflammatory bowel disease, Crohn's disease, and pouchitis in humans in vivo (Schultz, 2008), and to inhibit enteroinvasive *Salmonella*, *Legionella*, *Yersinia*, and *Shigella* in vitro (Altenhoefer et al., 2004). It is commonly accepted that *E. coli* Nissle's therapeutic efficacy and safety have convincingly been proven (Ukena et al., 2007). In some embodiments, the genetically engineered bacteria are *E. coli* Nissle and are naturally capable of promoting tight junctions and gut barrier function. In some embodiments, the genetically engineered bacteria are *E. coli* and are highly amenable to recombinant protein technologies.

One of ordinary skill in the art would appreciate that the genetic modifications disclosed herein may be adapted for other species, strains, and subtypes of bacteria. It is known, for example, that the clostridial butyrogenic pathway genes are widespread in the genome-sequenced *clostridia* and related species (Aboulnaga et al., 2013). Furthermore, genes from one or more different species of bacteria can be introduced into one another, e.g., the butyrogenic genes from *Peptoclostridium difficile* have been expressed in *Escherichia coli* (Aboulnaga et al., 2013).

In one embodiment, the recombinant bacterial cell does not colonize the subject having the disorder. Unmodified *E. coli* Nissle and the genetically engineered bacteria of the invention may be destroyed, e.g., by defense factors in the gut or blood serum (Sonnenborn et al., 2009) or by activation of a kill switch, several hours or days after administration. Thus, the genetically engineered bacteria may require continued administration. Residence time in vivo may be calculated for the genetically engineered bacteria. In some embodiments, the residence time is calculated for a human subject. In some embodiments, residence time in vivo is calculated for the genetically engineered bacteria of the invention, e.g. as described herein.

In some embodiments, the bacterial cell is a genetically engineered bacterial cell. In another embodiment, the bacterial cell is a recombinant bacterial cell. In some embodiments, the disclosure comprises a colony of bacterial cells disclosed herein.

In another aspect, the disclosure provides a recombinant bacterial culture which comprises bacterial cells disclosed herein.

In some embodiments, the genetically engineered bacteria comprising an anti-inflammatory or gut barrier enhancer molecule further comprise a kill-switch circuit, such as any of the kill-switch circuits provided herein. For example, in some embodiments, the genetically engineered bacteria further comprise one or more genes encoding one or more recombinase(s) under the control of an inducible promoter, and an inverted toxin sequence. In some embodiments, the genetically engineered bacteria further comprise one or more genes encoding an antitoxin. In some embodiments, the engineered bacteria further comprise one or more genes encoding one or more recombinase(s) under the control of an inducible promoter and one or more inverted excision genes, wherein the excision gene(s) encode an enzyme that deletes an essential gene. In some embodiments, the genetically engineered bacteria further comprise one or more genes encoding an antitoxin. In some embodiments, the engineered bacteria further comprise one or more genes encoding a toxin under the control of a promoter having a TetR repressor binding site and a gene encoding the TetR under the control of an inducible promoter that is induced by arabinose, such as ParaBAD. In some embodiments, the genetically engineered bacteria further comprise one or more genes encoding an antitoxin.

In some embodiments, the genetically engineered bacteria is an auxotroph comprising gene sequence encoding an anti-inflammatory or gut barrier enhancer molecule and further comprises a kill-switch circuit, such as any of the kill-switch circuits described herein.

In some embodiments of the above described genetically engineered bacteria, the gene encoding an anti-inflammatory or gut barrier enhancer molecule is present on a plasmid in the bacterium. In some embodiments, the gene sequence(s) encoding an anti-inflammatory or gut barrier enhancer molecule is present in the bacterial chromosome. In some embodiments, a gene sequence encoding a secretion protein or protein complex, such as any of the secretion systems disclosed herein, for secreting a biomolecule (e.g. an anti-inflammatory or gut barrier enhancer molecule), is present on a plasmid in the bacterium. In some embodiments, the gene sequence encoding a secretion protein or protein complex for secreting a biomolecule, such as any of the secretion systems disclosed herein, is present in the bacterial chromosome. In some embodiments, the gene sequence(s) encoding an antibiotic resistance gene is present on a plasmid in the bacterium. In some embodiments, the gene sequence(s) encoding an antibiotic resistance gene is present in the bacterial chromosome.

Anti-Inflammation and/or Gut Barrier Function Enhancer Molecules

The genetically engineered bacteria comprise one or more gene sequence(s) and/or gene cassette(s) for producing a non-native anti-inflammation and/or gut barrier function enhancer molecule. In some embodiments, the genetically engineered bacteria comprise one or more gene sequence(s) for producing a non-native anti-inflammation and/or gut barrier function enhancer molecule. For example, the genetically engineered bacteria may comprise two or more gene sequence(s) for producing a non-native anti-inflammation and/or gut barrier function enhancer molecule. In some embodiments, the two or more gene sequences are multiple copies of the same gene. In some embodiments, the two or more gene sequences are sequences encoding different genes. In some embodiments, the two or more gene sequences are sequences encoding multiple copies of one or more different genes. In some embodiments, the genetically engineered bacteria comprise one or more gene cassette(s) for producing a non-native anti-inflammation and/or gut barrier function enhancer molecule. For example, the genetically engineered bacteria may comprise two or more gene cassette(s) for producing a non-native anti-inflammation and/or gut barrier function enhancer molecule. In some embodiments, the two or more gene cassettes are multiple copies of the same gene cassette. In some embodiments, the two or more gene cassettes are different gene cassettes for producing either the same or different anti-inflammation and/or gut barrier function enhancer molecule(s). In some embodiments, the two or more gene cassettes are gene cassettes for producing multiple copies of one or more different anti-inflammation and/or gut barrier function enhancer molecule(s). In some embodiments, the anti-inflammation and/or gut barrier function enhancer molecule is selected from the group consisting of a short-chain fatty acid, butyrate, propionate, acetate, IL-2, IL-22, superoxide dismutase (SOD), GLP-2, GLP-1, IL-10 (human or viral), IL-27, TGF-β1, TGF-β2, N-acylphosphatidylethanolamines (NAPEs), elafin (also known as peptidase inhibitor 3 or SKALP), trefoil factor, melatonin, PGD2, kynurenic acid, kynurenine, typtophan metabolite, indole, indole metabolite, a single-chain variable fragment (scFv), antisense RNA, siRNA, or shRNA that neutralizes TNF-α, IFN-γ, IL-1β, IL-6, IL-8, IL-17, and/or chemokines, e.g., CXCL-8 and CCL2, AHR agonist (e.g., indole acetic acid, indole-3-aldehyde, and indole), PXR agonist (e.g., IPA), HDAC inhibitor (e.g., butyrate), GPR41 and/or GPR43 activator (e.g., butyrate and/or propionate and/or acetate), GPR109A activator (e.g., butyrate), inhibitor of NF-kappaB signaling (e.g., butyrate), modulator of PPARgamma (e.g., butyrate), activator of AMPK signaling (e.g., acetate), modulator of GLP-1 secretion, and hydroxyl radical scavengers and antioxidants (e.g., IPA). A molecule may be primarily anti-inflammatory, e.g., IL-10, or primarily gut barrier function enhancing, e.g., GLP-2. Alternatively, a molecule may be both anti-inflammatory and gut barrier function enhancing.

In some embodiments, the genetically engineered bacteria of the invention express one or more anti-inflammation and/or gut barrier function enhancer molecule(s) that is encoded by a single gene, e.g., the molecule is elafin and encoded by the PI3 gene, or the molecule is interleukin-10 and encoded by the IL10 gene. In alternate embodiments, the genetically engineered bacteria of the invention encode one or more an anti-inflammation and/or gut barrier function enhancer molecule(s), e.g., butyrate, that is synthesized by a biosynthetic pathway requiring multiple genes.

The one or more gene sequence(s) and/or gene cassette(s) may be expressed on a high-copy plasmid, a low-copy plasmid, or a chromosome. In some embodiments, expression from the plasmid may be useful for increasing expression of the anti-inflammation and/or gut barrier function enhancer molecule(s). In some embodiments, expression from the chromosome may be useful for increasing stability of expression of the anti-inflammation and/or gut barrier function enhancer molecule(s). In some embodiments, the gene sequence(s) or gene cassette(s) for producing the anti-inflammation and/or gut barrier function enhancer molecule(s) is integrated into the bacterial chromosome at one or more integration sites in the genetically engineered bacteria. For example, one or more copies of the butyrate biosynthesis gene cassette may be integrated into the bacterial chromosome. In some embodiments, the gene sequence(s) or gene cassette(s) for producing the anti-inflammation and/or gut barrier function enhancer molecule(s) is expressed from a plasmid in the genetically engineered bacteria. In some embodiments, the gene sequence(s) or gene cassette(s) for producing the anti-inflammation and/or gut barrier function enhancer molecule(s) is inserted into the bacterial genome at one or more of the following insertion sites in $E.$ $coli$ Nissle: malE/K, araC/BAD, lacZ, thyA, malP/T. Any suitable insertion site may be used (see, e.g., FIG. 51 for exemplary insertion sites). The insertion site may be anywhere in the genome, e.g., in a gene required for survival and/or growth, such as thyA (to create an auxotroph); in an active area of the genome, such as near the site of genome replication; and/or in between divergent promoters in order to reduce the risk of unintended transcription, such as between AraB and AraC of the arabinose operon.

Short Chain Fatty Acids and Tryptophan Metabolites

One strategy in the treatment, prevention, and/or management of inflammatory bowel disorders may include approaches to help maintain and/or reestablish gut barrier function, e.g. through the prevention, treatment and/or management of inflammatory events at the root of increased permeability, e.g. through the administration of anti-inflammatory effectors.

For example, leading metabolites that play gut-protective roles are short chain fatty acids, e.g. acetate, butyrate and propionate, and those derived from tryptophan metabolism. These metabolites have been shown to play a major role in the prevention of inflammatory disease. As such one approach in the treatment, prevention, and/or management of gut barrier health may be to provide a treatment which contains one or more of such metabolites.

For example, butyrate and other SCFA, e.g., derived from the microbiota, are known to promote maintaining intestinal integrity (e.g., as reviewed in Thorburn et al., Diet, Metabolites, and "Western-Lifestyle" Inflammatory Diseases; Immunity Volume 40, Issue 6, 19 Jun. 2014, Pages 833-842). (A) SCFA-induced promotion of mucus by gut epithelial cells, possibly through signaling through metabolite sensing GPCRs; (B) SCFA-induced secretion of IgA by B cells; (C) SCFA-induced promotion of tissue repair and wound healing; (D) SCFA-induced promotion of Treg cell development in the gut in a process that presumably facilitates immunological tolerance; (E) SCFA-mediated enhancement of epithelial integrity in a process dependent on inflammasome activation (e.g., via NALP3) and IL-18 production; and (F) anti-inflammatory effects, inhibition of inflammatory cytokine production (e.g., TNF, 11-6, and IFN-gamma), and inhibition of NF-κB. Many of these actions of SCFAs in gut homeostatis can be ascribed to GPR43 and GPR109A, which are expressed by the colonic epithelium, by inflammatory leukocytes (e.g. neutrophils and marcophages) and by Treg cells. These receptors signal through G proteins, coupled to MAPK, PI3K and mTOR, as well as a separate arrestin-pathway, leading to NFkappa B inhibition. Other effects can be ascribed to SCFA-mediated HDAC inhibition, e.g. butyrate, which may regulate macrophage function and promote TReg cells.

In addition, a number of trptophan metabolites, including kynurenine and kynurenic acid, as well as several indoles, such as indole-3 aldehhyde, indole-3 propionic acid, and several other indole metabolites (which can be derived from microbiota or the diet) described infra, have been shown to be essential for gut homeostais and promote gut-barrier health. These metabolites bind to aryl hydrocarbon receptor (Ahr). After agonist binding, AhR translocates to the nucleus, where it forms a heterodimer with AhR nuclear translocator (ARNT). AhR-dependent gene expression includes genes involved in the production of mediators important for gut homeostasis; these mediators include IL-22, antimicrobicidal factors, increased Th17 cell activity, and the maintenance of intraepithelial lymphocytes and RORγt+ innate lymphoid cells.

Tryptophan can also be transported across the epithelium by transport machinery comprising angiotensin I converting enzyme 2 (Ace2). Tryptophan is degraded to kynurenine, another AhR agonist, by the immune-regulatory enzyme indoleamine 2,3-dioxygenase (IDO), which is linked to suppression of T cell responses, promotion of Treg cells, and immune tolerance. Moreover, a number of tryptophan metabolites, including kynurenic acid and niacin, agonize metabolite-sensing GPCRs, such as GPR35 and GPR109A and thus multiple elements of tryptophan catabolism facilitate gut homeostasis.

In addition, some indole metabolites, e.g., indole 3-propionic acid (IPA), may exert their effect an activating ligand of Pregnane X receptor (PXR), which is thought to play a key role as an essential regulator of intestinal barrier function, through downregulation of TLR4 signaling (Venkatesh et al., 2014 Symbiotic Bacterial Metabolites Regulate Gastrointestinal Barrier Function via the Xenobiotic Sensor PXR and Toll-like Receptor 4; Immunity 41, 296-310, Aug. 21, 2014). As a result, indole levels may through the activation of PXR regulate and balance the levels of TLR4 expression to promote homeostasis and gut barrier health.

Thus, in some embodiments, the genetically engineered bacteria of the disclosure produce one or more short chain fatty acids and/or one or more tryprophan metabolites Butyrate In some embodiments, the genetically engineered bacteria of the invention comprise a butyrogenic gene cassette and are capable of producing butyrate under particular exogenous environmental conditions. The genetically engineered bacteria may include any suitable set of butyrogenic genes (see, e.g., Table 2 and Table 3). Unmodified bacteria comprising butyrate biosynthesis genes are known and include, but are not limited to, *Peptoclostridium, Clostridium, Fusobacterium, Butyrivibrio, Eubacterium*, and *Treponema*. In some embodiments, the genetically engineered bacteria of the invention comprise butyrate biosynthesis genes from a different species, strain, or substrain of bacteria. In some embodiments, the genetically engineered bacteria comprise the eight genes of the butyrate biosynthesis pathway from *Peptoclostridium difficile*, e.g., *Peptoclostridium difficile* strain 630: bcd2, etfB3, etfA3, thiA1, hbd, crt2, pbt, and buk (Aboulnaga et al., 2013) and are capable of producing butyrate. *Peptoclostridium difficile* strain 630 and strain 1296 are both capable of producing butyrate, but comprise different nucleic acid sequences for etfA3, thiA1, hbd, crt2, pbt, and buk. In some embodiments, the genetically engineered bacteria comprise a combination of butyrogenic genes from different species, strains, and/or substrains of bacteria and are capable of producing butyrate. For example, in some embodiments, the genetically engineered bacteria comprise bcd2, etfB3, etfA3, and thiA1 from *Peptoclostridium difficile* strain 630, and hbd, crt2, pbt, and buk from *Peptoclostridium difficile* strain 1296. Alternatively, a single gene from *Treponema denticola* (ter, encoding trans-2-enoynl-CoA reductase) is capable of functionally replacing all three of the bcd2, etfB3, and etfA3 genes from *Peptoclostridium difficile*. Thus, a butyrogenic gene cassette may comprise thiA1, hbd, crt2, pbt, and buk from *Peptoclostridium difficile* and ter from *Treponema denticola*. In another example of a butyrate gene cassette, the pbt and buk genes are replaced with tesB (e.g., from *E coli*). Thus a butyrogenic gene cassette may comprise ter, thiA1, hbd, crt2, and tesB.n some embodiments, the genetically engineered bacteria are capable of expressing the butyrate biosynthesis cassette and producing butyrate in low-oxygen conditions, in the presence of certain molecules or metabolites, in the presence of molecules or metabolites associated with inflammation or an inflammatory response, or in the presence of some other metabolite that may or may not be present in the gut, such as arabinose. One or more of the butyrate biosynthesis genes may be functionally replaced or modified, e.g., codon optimized.

In some embodiments, additional genes may be mutated or knocked out, to further increase the levels of butyrate production. Production under anaerobic conditions depends on endogenous NADH pools. Therefore, the flux through the butyrate pathway may be enhanced by eliminating competing routes for NADH utilization. Non-limiting examples of such competing routes are frdA (converts phosphoenolpyruvate to succinate), ldhA (converts pyruvate to lactate) and adhE (converts Acetyl-CoA to Ethanol). Thus, in certain embodiments, the genetically engineered bacteria further comprise mutations and/or deletions in one or more of frdA, ldhA, and adhE.

Table 2 depicts the nucleic acid sequences of exemplary genes in exemplary butyrate biosynthesis gene cassettes.

TABLE 2

Exemplary Butyrate Cassette Sequences

| Description | Sequence |
|---|---|
| bcd2<br>SEQ ID NO: 1 | ATGGATTTAAATTCTAAAAAATATCAGATGCTTAAAGAGCTATATGTAAG<br>CTTCGCTGAAAATGAAGTTAAACCTTTAGCAACAGAACTTGATGAAGAAG<br>AAAGATTTCCTTATGAAACAGTGGAAAAAATGCCAAAAGCAGGAATGATG<br>GGTATACCATATCCAAAAGAATATGGTGGAGAAGGTGGAGACACTGTAGG<br>ATATATAATGGCAGTTGAAGAATTGTCTAGAGTTTGTGGTACTACAGGAG<br>TTATATTATCAGCTCATACATCTCTTGGCTCATGGCCTATATATCAATAT<br>GGTAATGAAGAACAAAAACAAAAATTCTTAAGACCACTAGCAAGTGGAGA<br>AAAATTAGGAGCATTTGGTCTTACTGAGCCTAATGCTGGTACAGATGCGT<br>CTGGCCAACAAACAACTGCTGTTTTAGACGGGGATGAATACATACTTAAT<br>GGCTCAAAAATATTTATAACAAACGCAATAGCTGGTGACATATATGTAGT<br>AATGGCAATGACTGATAAATCTAAGGGGAACAAAGGAATATCAGCATTTA<br>TAGTTGAAAAAGGAACTCCTGGGTTTAGCTTTGGAGTTAAAGAAAAGAAA<br>ATGGGTATAAGAGGTTCAGCTACGAGTGAATTAATATTTGAGGATTGCAG<br>AATACCTAAAGAAAATTTACTTGGAAAAGAAGGTCAAGGATTTAAGATAG<br>CAATGTCTACTCTTGATGGTGGTAGAATTGGTATAGCTGCACAAGCTTTA<br>GGTTTAGCACAAGGTGCTCTTGATGAAACTGTTAAATATGTAAAAGAAAG<br>AGTACAATTTGGTAGACCATTATCAAAATTCCAAAATACACAATTCCAAT<br>TAGCTGATATGGAAGTTAAGGTACAAGCGGCTAGACACCTTGTATATCAA<br>GCAGCTATAAATAAAGACTTAGGGAAAACCTTATGGAGTAGAAGCAGCAAT<br>GGCAAAATTATTTGCAGCTGAAACAGCTATGGAAGTTACTACAAAAGCTG<br>TACAACTTCATGGAGGATATGGATACACTCGTGACTATCCAGTAGAAAGA<br>ATGATGAGAGATGCTAAGATAACTGAAATATATGAAGGAACTAGTGAAGT<br>TCAAAGAATGGTTATTTCAGGAAAACTATTAAAATAG |
| etfB3<br>SEQ ID NO: 2 | ATGAATATAGTCGTTTGTATAAAACAAGTTCCAGATACAACAGAAGTTAA<br>ACTAGATCCTAATACAGGTACTTTAATTAGAGATGGAGTACCAAGTATAA<br>TAAACCCTGATGATAAAGCAGGTTTAGAAGAAGCTATAAAATTAAAAGAA<br>GAAATGGGTGCTCATGTAACTGTTATAACAATGGGACCTCCTCAAGCAGA<br>TATGGCTTTAAAAGAAGCTTTAGCAATGGGTGCAGATAGAGGTATATTAT<br>TAACAGATAGAGCATTTGCGGGTGCTGATACTTGGGCAACTTCATCAGCA<br>TTAGCAGGAGCATTAAAAAATATAGATTTTGATATTATAATAGCTGGAAG<br>ACAGGCGATAGATGGAGATACTGCACAAGTTGGACCTCAAATAGCTGAAC<br>ATTTAAATCTTCCATCAATAACATATGCTGAAGAAATAAAAACTGAAGGT<br>GAATATGTATTAGTAAAAAGACAATTTGAAGATTGTTGCCATGACTTAAA<br>AGTTAAAATGCCATGCCTTATAACAACTCTTAAAGATATGAACACACCAA<br>GATACATGAAAGTTGGAAGAATATATGATGCTTTCGAAAATGATGTAGTA<br>GAAACATGGACTGTAAAAGATATAGAAGTTGACCCTTCTAATTTAGGTCT<br>TAAAGGTTCTCCAACTAGTGTATTTAAATCATTTACAAAATCAGTTAAAC<br>CAGCTGGTACAATATACAATGAAGATGCGAAAACATCAGCTGGAATTATC<br>ATAGATAAATTAAAAGAGAAGTATATCATATAA |

TABLE 2-continued

Exemplary Butyrate Cassette Sequences

| Description | Sequence |
|---|---|
| etfA3<br>SEQ ID NO: 3 | ATGGGTAACGTTTTAGTAGTAATAGAACAAAGAGAAAATGTAATTCAAAC<br>TGTTTCTTTAGAATTACTAGGAAAGGCTACAGAAATAGCAAAAGATTATG<br>ATACAAAAGTTTCTGCATTACTTTTAGGTAGTAAGGTAGAAGGTTTAATA<br>GATACATTAGCACACTATGGTGCAGATGAGGTAATAGTAGTAGATGATGA<br>AGCTTTAGCAGTGTATACAACTGAACCATATACAAAAGCAGCTTATGAAG<br>CAATAAAAGCAGCTGACCCTATAGTTGTATTATTTGGTGCAACTTCAATA<br>GGTAGAGATTTAGCGCCTAGAGTTTCTGCTAGAATACATACAGGTCTTAC<br>TGCTGACTGTACAGGTCTTGCAGTAGCTGAAGATACAAAATTATTATTAA<br>TGACAAGACCTGCCTTTGGTGGAAATATAATGGCAACAATAGTTTGTAAA<br>GATTTCAGACCTCAAATGTCTACAGTTAGACCAGGGGTTATGAAGAAAAA<br>TGAACCTGATGAAACTAAAGAAGCTGTAATTAACCGTTTCAAGGTAGAAT<br>TTAATGATGCTGATAAATTAGTTCAAGTTGTACAAGTAATAAAAGAAGCT<br>AAAAAACAAGTTAAAATAGAAGATGCTAAGATATTAGTTTCTGCTGGACG<br>TGGAATGGGTGGAAAAGAAAACTTAGACATACTTTATGAATTAGCTGAAA<br>TTATAGGTGGAGAAGTTTCTGGTTCTCGTGCCACTATAGATGCAGGTTGG<br>TTAGATAAAGCAAGACAAGTTGGTCAAACTGGTAAAACTGTAAGACCAGA<br>CCTTTATATAGCATGTGGTATATCTGGAGCAATACAACATATAGCTGGTA<br>TGGAAGATGCTGAGTTTATAGTTGCTATAAATAAAAATCCAGAAGCTCCA<br>ATATTTAAATATGCTGATGTTGGTATAGTTGGAGATGTTCATAAAGTGCT<br>TCCAGAACTTATCAGTCAGTTAAGTGTTGCAAAAGAAAAGGTGAAGTTT<br>TAGCTAACTAA |
| thiA1<br>SEQ ID NO: 4 | ATGAGAGAAGTAGTAATTGCCAGTGCAGCTAGAACAGCAGTAGGAAGTTT<br>TGGAGGAGCATTTAAATCAGTTTCAGCGGTAGAGTTAGGGGTAACAGCAG<br>CTAAAGAAGCTATAAAAAGAGCTAACATAACTCCAGATATGATAGATGAA<br>TCTCTTTTAGGGGGAGTACTTACAGCAGGTCTTGGACAAAATATAGCAAG<br>ACAAATAGCATTAGGAGCAGGAATACCAGTAGAAAAACCAGCTATGACTA<br>TAAATATAGTTTGTGGTTCTGGATTAAGATCTGTTTCAATGGCATCTCAA<br>CTTATAGCATTAGGTGATGCTGATATAATGTTAGTTGGTGGAGCTGAAAA<br>CATGAGTATGTCTCCTTATTTAGTACCAAGTGCGAGATATGGTGCAAGAA<br>TGGGTGATGCTGCTTTTGTTGATTCAATGATAAAAGATGGATTATCAGAC<br>ATATTTAATAACTATCACATGGGTATTACTGCTGAAAACATAGCAGAGCA<br>ATGGAATATAACTAGAGAAGAACAAGATGAATTAGCTCTTGCAAGTCAAA<br>ATAAAGCTGAAAAAGCTCAAGCTGAAGGAAAATTTGATGAAGAAATAGTT<br>CCTGTTGTTATAAAAGGAAGAAAAGGTGACACTGTAGTAGATAAAGATGA<br>ATATATTAAGCCTGGCACTACAATGGAGAAACTTGCTAAGTTAAGACCTG<br>CATTTAAAAAAGATGGAACAGTTACTGCTGGTAATGCATCAGGAATAAAT<br>GATGGTGCTGCTATGTTAGTAGTAATGGCTAAAGAAAAAGCTGAAGAACT<br>AGGAATAGAGCCTCTTGCAACTATAGTTTCTTATGGAACAGCTGGTGTTG<br>ACCCTAAAATAATGGGATATGGACCAGTTCCAGCAACTAAAAAAGCTTTA<br>GAAGCTGCTAATATGACTATTGAAGATATAGATTTAGTTGAAGCTAATGA<br>GGCATTTGCTGCCCAATCTGTAGCTGTAATAAGAGACTTAAATATAGATA<br>TGAATAAAGTTAATGTTAATGGTGGAGCAATAGCTATAGGACATCCAATA<br>GGATGCTCAGGAGCAAGAATACTTACTACACTTTTATATGAAATGAAGAG<br>AAGAGATGCTAAAACTGGTCTTGCTACACTTTGTATAGGCGGTGGAATGG<br>GAACTACTTTAATAGTTAAGAGATAG |
| hbd<br>SEQ ID NO: 5 | ATGAAATTAGCTGTAATAGGTAGTGGAACTATGGGAAGTGGTATTGTACA<br>AACTTTTGCAAGTTGTGGACATGATGTATGTTTAAAGAGTAGAACTCAAG<br>GTGCTATAGATAAATGTTTAGCTTTATTAGATAAAAATTTAACTAAGTTA<br>GTTACTAAGGGAAAAATGGATGAAGCTACAAAAGCAGAAATATTAAGTCA<br>TGTTAGTTCAACTACTAATTATGAAGATTTAAAAGATATGGATTTAATAA<br>TAGAAGCATCTGTAGAAGACATGAATATAAAGAAAGATGTTTTCAAGTTA<br>CTAGATGAATTATGTAAAGAAGATACTATCTTGGCAACAAATACTTCATC<br>ATTATCTATAACAGAAATAGCTTCTTCTACTAAGCGCCCAGATAAAGTTA<br>TAGGAATGCATTTCTTTAATCCAGTTCCTATGATGAAATTAGTTGAAGTT<br>ATAAGTGGTCAGTTAACATCAAAAGTTACTTTTGATACAGTATTTGAATT<br>ATCTAAGAGTATCAATAAAGTACCAGTAGATGTATCTGAATCTCCTGGAT<br>TTGTAGTAAATAGAATACTTATACCTATGATAAATGAAGCTGTTGGTATA<br>TATGCAGATGGTGTTGCAAGTAAAGAAGAAATAGATGAAGCTATGAAATT<br>AGGAGCAAACCATCCAATGGGACCACTAGCATTAGGTGATTTAATCGGAT<br>TAGATGTTGTTTTAGCTATAATGAACGTTTTATATACTGAATTTGGAGAT<br>ACTAAATATAGACCTCATCCACTTTTAGCTAAAATGGTTAGAGCTAATCA<br>ATTAGGAAGAAAAACTAAGATAGGATTCTATGATTATAATAAATAA |
| crt2<br>SEQ ID NO: 6 | ATGAGTACAAGTGATGTTAAAGTTTATGAGAATGTAGCTGTTGAAGTAGA<br>TGGAAATATATGTACAGTGAAAATGAATAGACCTAAAGCCCTTAATGCAA<br>TAAATTCAAAGACTTTAGAAGAACTTTATGAAGTATTTGTAGATATTAAT<br>AATGATGAAACTATTGATGTTGTAATATTGACAGGGGAAGGAAAGGCATT<br>TGTAGCTGGAGCAGATATTGCATACATGAAAGATTTAGATGCTGTAGCTG<br>CTAAAGATTTTAGTATCTTAGGAGCAAAAGCTTTTGGAGAAATAGAAAAT<br>AGTAAAAAAGTAGTGATAGCTGCTGTAAACGGATTTGCTTTAGGTGGAGG<br>ATGTGAACTTGCAATGGCATGTGATATAAGAATTGCATCTGCTAAAGCTA<br>AATTTGGTCAGCCAGAAGTAACTCTTGGAATAACTCCAGGATATGGAGGA<br>ACTCAAAGGCTTACAAGATGGTTGGAATGGCAAAAGCAAAAGAATTAAT<br>CTTTACAGGTCAAGTTATAAAAGCTGATGAAGCTGAAAAAATAGGGCTAG |

TABLE 2-continued

Exemplary Butyrate Cassette Sequences

| Description | Sequence |
|---|---|
| | TAAATAGAGTCGTTGAGCCAGACATTTTAATAGAAGAAGTTGAGAAATTA<br>GCTAAGATAATAGCTAAAAATGCTCAGCTTGCAGTTAGATACTCTAAAGA<br>AGCAATACAACTTGGTGCTCAAACTGATATAAATACTGGAATAGATATAG<br>AATCTAATTTATTTGGTCTTTGTTTTTCAACTAAAGACCAAAAAGAAGGA<br>ATGTCAGCTTTCGTTGAAAAGAGAGAAGCTAACTTTATAAAAGGGTAA |
| pbt<br>SEQ ID NO: 7 | ATGAGAAGTTTTGAAGAAGTAATTAAGTTTGCAAAAGAAAGAGGACCTAA<br>AACTATATCAGTAGCATGTTGCCAAGATAAAGAAGTTTTAATGGCAGTTG<br>AAATGGCTAGAAAAGAAAAAATAGCAAATGCCATTTTAGTAGGAGATATA<br>GAAAAGACTAAAGAAATTGCAAAAAGCATAGACATGGATATCGAAAATTA<br>TGAACTGATAGATATAAAAGATTTAGCAGAAGCATCTCTAAAATCTGTTG<br>AATTAGTTTCACAAGGAAAAGCCGACATGGTAATGAAAGGCTTAGTAGAC<br>ACATCAATAATACTAAAAGCAGTTTTAAATAAAGAAGTAGGTCTTAGAAC<br>TGGAAATGTATTAAGTCACGTAGCAGTATTTGATGTAGAGGGATATGATA<br>GATTATTTTTCGTAACTGACGCAGCTATGAACTTAGCTCCTGATACAAAT<br>ACTAAAAAGCAAATCATAGAAAATGCTTGCACAGTAGCACATTCATTAGA<br>TATAAGTGAACCAAAAGTTGCTGCAATATGCGCAAAAGAAAAAGTAAATC<br>CAAAAATGAAAGATACAGTTGAAGCTAAAGAACTAGAAGAAATGTATGAA<br>AGAGGAGAAATCAAAGGTTGTATGGTTGGTGGGCCTTTTGCAATTGATAA<br>TGCAGTATCTTTAGAAGCAGCTAAACATAAAGGTATAAATCATCCTGTAG<br>CAGGACGAGCTGATATATTATTAGCCCCAGATATTGAAGGTGGTAACATA<br>TTATATAAAGCTTTGGTATTCTTCTCAAAATCAAAAAATGCAGGAGTTAT<br>AGTTGGGGCTAAAGCACCAATAATATTAACTTCTAGAGCAGACAGTGAAG<br>AAACTAAACTAAACTCAATAGCTTTAGGTGTTTTAATGGCAGCAAAGGCA<br>TAA |
| buk<br>SEQ ID NO: 8 | ATGAGCAAAATATTTAAAATCTTAACAATAAATCCTGGTTCGACATCAAC<br>TAAAATAGCTGTATTTGATAATGAGGATTTAGTATTTGAAAAAACTTTAA<br>GACATTCTTCAGAAGAAATAGGAAAATATGAGAAGGTGTCTGACCAATTT<br>GAATTTCGTAAACAAGTAATAGAAGAAGCTCTAAAAGAAGGTGGAGTAAA<br>AACATCTGAATTAGATGCTGTAGTAGGTAGAGGAGGACTTCTTAAACCTA<br>TAAAAGGTGGTACTTATTCAGTAAGTGCTGCTATGATTGAAGATTTAAAA<br>GTGGGAGTTTTAGGAGAACACGCTTCAAACCTAGGTGGAATAATAGCAAA<br>ACAAATAGGTGAAGAAGTAAATGTTCCTTCATACATAGTAGACCCTGTTG<br>TTGTAGATGAATTAGAAGATGTTGCTAGAATTTCTGGTATGCCTGAAATA<br>AGTAGAGCAAGTGTAGTACATGCTTTAAATCAAAAGGCAATAGCAAGAAG<br>ATATGCTAGAGAAATAAACAAGAAATATGAAGATATAAATCTTATAGTTG<br>CACACATGGGTGGAGGAGTTTCTGTTGGAGCTCATAAAAATGGTAAAATA<br>GTAGATGTTGCAAACGCATTAGATGGAGAAGGACCTTTCTCTCCAGAAAG<br>AAGTGGTGGACTACCAGTAGGTGCATTAGTAAAAATGTGCTTTAGTGGAA<br>AATATACTCAAGATGAAATTAAAAAGAAAATAAAAGGTAATGGCGGACTA<br>GTTGCATACTTAAACACTAATGATGCTAGAGAAGTTGAAGAAAGAATTGA<br>AGCTGGTGATGAAAAAGCTAAATTAGTATATGAAGCTATGGCATATCAAA<br>TCTCTAAAGAAATAGGAGCTAGTGCTGCAGTTCTTAAGGGAGATGTAAAA<br>GCAATATTATTAACTGGTGGAATCGCATATTCAAAAATGTTTACAGAAAT<br>GATTGCAGATAGAGTTAAATTTATAGCAGATGTAAAAGTTTATCCAGGTG<br>AAGATGAAATGATTGCATTAGCTCAAGGTGGACTTAGAGTTTTAACTGGT<br>GAAGAAGAGGCTCAAGTTTATGATAACTAA |
| ter<br>SEQ ID NO: 9 | ATGATCGTAAAACCTATGGTACGCAACAATATCTGCCTGAACGCCCATCC<br>TCAGGGCTGCAAGAAGGGAGTGGAAGATCAGATTGAATATACCAAGAAAC<br>GCATTACCGCAGAAGTCAAAGCTGGCGCAAAAGCTCCAAAAAACGTTCTG<br>GTGCTTGGCTGCTCAAATGGTTACGCCTGGCGAGCCGCATTACTGCTGC<br>GTTCGGATACGGGGCTGCGACCATCGGCGTGTCCTTTGAAAAAGCGGGTT<br>CAGAAACCAAATATGGTACACCGGGATGGTACAATAATTTGGCATTTGAT<br>GAAGCGGCAAAACGCGAGGGTCTTTATAGCGTGACGATCGACGGCGATGC<br>GTTTTCAGACGAGATCAAGGCCCAGGTAATTGAGGAAGCCAAAAAAAAAG<br>GTATCAAATTTGATCTGATCGTATACAGCTTGGCCAGCCCAGTACGTACT<br>GATCCTGATACAGGTATCATGCACAAAAGCGTTTTGAAACCCTTTGGAAA<br>AACGTTCACAGGCAAAACAGTAGATCCGTTTACTGGCGAGCTGAAGGAAA<br>TCTCCGCGGAACCAGCAAATGACGAGGAAGCAGCCGCCACTGTTAAAGTT<br>ATGGGGGGTGAAGATTGGGAACGTTGGATTAAGCAGCTGTCGAAGGAAGG<br>CCTCTTAGAAGAAGGCTGTATTACCTTGGCCTATAGTTATATTGGCCCTG<br>AAGCTACCCAAGCTTTGTACCGTAAAGGCACAATCGGCAAGGCCAAAGAA<br>CACCTGGAGGCCACAGCACACCGTCTCAACAAAGAGAACCCGTCAATCCG<br>TGCCTTCGTGAGCGTGAATAAAGGCCTGGTAACCCGCGCAAGCGCCGTAA<br>TCCCGGTAATCCCTCTGTATCTCGCCAGCTTGTTCAAAGTAATGAAAGAG<br>AAGGGCAATCATGAAGGTTGTATTGAACAGATCACGCGTCTGTACGCCGA<br>GCGCCTGTACCGTAAAGATGGTACAATTCCAGTTGATGAGGAAAATCGCA<br>TTCGCATTGATGATTGGGAGTTAGAAGAAGACGTCCAGAAAGCGGTATCC<br>GCGTTGATGGAGAAAGTCACGGGTGAAAACGCAGAATCTCTCACTGACTT<br>AGCGGGGTACCGCCATGATTTCTTAGCTAGTAACGGCTTTGATGTAGAAG<br>GTATTAATTATGAAGCGGAAGTTGAACGCTTCGACCGTATCGA |

TABLE 2-continued

Exemplary Butyrate Cassette Sequences

| Description | Sequence |
|---|---|
| tesB<br>SEQ ID NO: 10 | ATGAGTCAGGCGCTAAAAAATTTACTGACATTGTTAAATCTGGAAAAAAT<br>TGAGGAAGGACTCTTTCGCGGCCAGAGTGAAGATTTAGGTTTACGCCAGG<br>TGTTTGGCGGCCAGGTCGTGGGTCAGGCCTTGTATGCTGCAAAAGAGACC<br>GTCCCTGAAGAGCGGCTGGTACATTCGTTTCACAGCTACTTTCTTCGCCC<br>TGGCGATAGTAAGAAGCCGATTATTTATGATGTCGAAACGCTGCGTGACG<br>GTAACAGCTTCAGCGCCCGCCGGGTTGCTGCTATTCAAAACGGCAAACCG<br>ATTTTTTATATGACTGCCTCTTTCCAGGCACCAGAAGCGGGTTTCGAACA<br>TCAAAAAACAATGCCGTCCGCGCCAGCGCCTGATGGCCTCCCTTCGGAAA<br>CGCAAATCGCCCAATCGCTGGCGCACCTGCTGCCGCCAGTGCTGAAAGAT<br>AAATTCATCGCGATCGTCCGCTGGAAGTCCGTCCGGTGGAGTTTCATAA<br>CCCACTGAAAGGTCACGTCGCAGAACCACATCGTCAGGTGTGGATCCGCG<br>CAAATGGTAGCGTGCCGGATGACCTGCGCGTTCATCAGTATCTGCTCGGT<br>TACGCTTCTGATCTTAACTTCCTGCCGGTAGCTCTACAGCCGCACGGCAT<br>CGGTTTTCTCGAACCGGGGATTCAGATTGCCACCATTGACCATTCCATGT<br>GGTTCCATCGCCCGTTTAATTTGAATGAATGGCTGCTGTATAGCGTGGAG<br>AGCACCTCGGCGTCCAGCGCCACGTGGCTTTGTGCGCGGTGAGTTTTATAC<br>CCAAGACGGCGTACTGGTTGCCTCGACCGTTCAGGAAGGGGTGATGCGTA<br>ATCACAATTAA |

Exemplary polypeptide sequences for the production of butyrate by the genetically engineered bacteria are provided in Table 3.

TABLE 3

Exemplary Polypeptide Sequences for Butyrate Production

| Description | Sequence |
|---|---|
| Bcd2<br>SEQ ID NO: 11 | MDLNSKKYQMLKELYVSFAENEVKPLATELDEEER<br>FPYETVEKMAKAGMMGIPYPKEYGGEGGDTVGYIM<br>AVEELSRVCGTTGVILSAHTSLGSWPIYQYGNEEQK<br>QKFLRPLASGEKLGAFGLTEPNAGTDASGQQTTAVL<br>DGDGDEYILNGSKIFITNAIAGDIYVVMAMTDKSKGNK<br>GISAFIVEKGTPGFSFGVKEKKMGIRGSATSELIFEDC<br>RIPKENLLGKEGGFKIAMSTLDGGRIGIAAQALGLA<br>QGALDETVKYVKERVQFGRPLSKFQNTQFQLADME<br>VKVQAARHLVYQAAINKDLGKPYGVEAAMAKLFA<br>AETAMEVTTKAVQLHGGYGYTRDYPVERMMRDAK<br>ITEIYEGTSEVQRMVISGKLLK |
| etfB3<br>SEQ ID NO: 12 | MNIVVCIKQVPDTTEVKLDPNTGTLIRDGVPSIINPDD<br>KAGLEEAIKLKEEMGAHVTVITMGPPQADMALKEA<br>LAMGADRGILLTDRAFAGADTWATSSALAGALKNI<br>DFDIIIAGRQAIDGDTAQVGPQIAEHLNLPSITYAEEIK<br>TEGEYVLVKRQFEDCCHDLKVKMPCLITTLKDMNT<br>PRYMKVGRIYDAFENDVVETWTVKDIEVDPSNLGL<br>KGSPTSVFKSFTKSVKPAGTIYNEDAKTSAGIIIDKLK<br>EKYII |
| etfA3<br>SEQ ID NO: 13 | MGNVLVVIEQRENVIQTVSLELLGKATEIAKDYDTK<br>VSALLLGSKVEGLIDTLAHYGADEVIVVDDEALAVY<br>TTEPYTKAAYEAIKAADPIVVLFGATSIGRDLAPRVS<br>ARIHTGLTADCTGLAVAEDTKLLLMTRPAFGGNIMA<br>TIVCKDFRPQMSTVRPGVMKKNEPDETKEAVINRFK<br>VEFNDADKLVQVVQVIKEAKKQVKIEDAKILVSAGR<br>GMGGKENLDILYELAEIIGGEVSGSRATIDAGWLDK<br>ARQVGQTGKTVRPDLYIACGISGAIQHIAGMEDAEFI<br>VAINKNPEAPIFKYADVGIVGDVHKVLPELISQLSVA<br>KEKGEVLAN |
| Ter<br>SEQ ID NO: 14 | MIVKPMVRNNICLNAHPQGCKKGVEDQIEYTKKRIT<br>AEVKAGAKAPKNVLVLGCSNGYGLASRITAAFGYG<br>AATIGVSFEKAGSETKYGTPGWYNNLAFDEAAKRE<br>GLYSVTIDGDAFSDEIKAQVIEEAKKKGIKFDLIVYSL<br>ASPVRTDPDTGIMHKSVLKPFGKTFTGKTVDPFTGEL<br>KEISAEPANDEEAAATVKVMGGEDWERWIKQLSKE<br>GLLEEGCITLAYSYIGPEATQALYRKGTIGKAKEHLE<br>ATAHRLNKENPSIRAFVSVNKGLVTRASAVIPVIPLY<br>LASLFKVMKEKGNHEGCIEQITRLYAERLYRKDGTIP<br>VDEENRIRIDDWELEEDVQKAVSALMEKVTGENAES<br>LTDLAGYRHDFLASNGFDVEGINYEAEVERFDRI |
| ThiA<br>SEQ ID NO: 15 | MREVVIASAARTAVGSFGGAFKSVSAVELGVTAAK<br>EAIKRANITPDMIDESLLGGVLTAGLGQNIARQIALG<br>AGIPVEKPAMTINIVCGSGLRSVSMASQLIALGDADI<br>MLVGGAENMSMSPYLVPSARYGARMGDAAFVDSM<br>IKDGLSDIFNNYHMGITAENIAEQWNITREEQDELAL<br>ASQNKAEKAQAEGKFDEEIVPVVIKGRKGDTVVDK<br>DEYIKPGTTMEKLAKLRPAFKKDGTVTAGNASGIND<br>GAAMLVVMAKEKAEELGIEPLATIVSYGTAGVDPKI<br>MGYGPVPATKKALEAANMTIEDIDLVEANEAFAAQ<br>SVAVIRDLNIDMNKVNVNGGAIAIGHPIGCSGARILT<br>TLLYEMKRRDAKTGLATLCIGGGMGTTLIVKR |
| Hbd<br>SEQ ID NO: 16 | MKLAVIGSGTMGSGIVQTFASCGHDVCLKSRTQGAI<br>DKCLALLDKNLTKLVTKGKMDEATKAEILSHVSSTT<br>NYEDLKDMDLIIEASVEDMNIKKDVFKLLDELCKED<br>TILATNTSSLSITEIASSTKRPDKVIGMHFFNPVPMMK<br>LVEVISGQLTSKVTFDTVFELSKSINKVPVDVSESPGF<br>VVNRILIPMINEAVGIYADGVASKEEIDEAMKLGAN<br>HPMGPLALGDLIGLDVVLAIMNVLYTEFGDTKYRPH<br>PLLAKMVRANQLGRKTKIGFYDYNK |
| Crt2<br>SEQ ID NO: 17 | MSTSDVKVYENVAVEVDGNICTVKMNRPKALNAIN<br>SKTLEELYEVFVDINNDETIDVVILTGEGKAFVAGAD<br>IAYMKDLDAVAAKDFSILGAKAFGEIENSKKVVIAA<br>VNGFALGGGCELAMACDIRIASAKAKFGQPEVTLGI<br>TPGYGGTQRLTRLVGMAKAKELIFTGQVIKADEAEK<br>IGLVNRVVEPDILIEEVEKLAKIIAKNAQLAVRYSKE<br>AIQLGAQTDINTGIDIESNLFGLCFSTKDQKEGMSAF<br>VEKREANFIKG |
| Pbt<br>SEQ ID NO: 18 | MRSFEEVIKFAKERGPKTISVACCQDKEVLMAVEMA<br>RKEKIANAILVGDIEKTKEIAKSIDMDIENYELIDIKD<br>LAEASLKSVELVSQGKADMVMKGLVDTSIILKAVLN<br>KEVGLRTGNVLSHVAVFDVEGYDRLFFVTDAAMNL<br>APDTNTKKQIIENACTVAHSLDISEPKVAAICAKEKV<br>NPKMKDTVEAKELEEMYERGEIKGCMVGGPFAIDN<br>AVSLEAAKHKGINHPVAGRADILLAPDIEGGNILYKA<br>LVFFSKSKNAGVIVGAKAPIILTSRADSEETKLNSIAL<br>GVLMAAKA |

TABLE 3-continued

Exemplary Polypeptide Sequences
for Butyrate Production

| Description | Sequence |
|---|---|
| Buk<br>SEQ ID NO:<br>19 | MSKIFKILTINPGSTSTKIAVFDNEDLVFEKTLRHSSE<br>EIGKYEKVSDQFEFRKQVIEEALKEGGVKTSELDAV<br>VGRGGLLKPIKGGTYSVSAAMIEDLKVGVLGEHASN<br>LGGIIAKQIGEEVNVPSYIVDPVVVDELEDVARISGM<br>PEISRASVVHALNQKAIARRYAREINKKYEDINLIVA<br>HMGGGVSVGAHKNGKIVDVANALDGEGPFSPERSG<br>GLPVGALVKMCFSGKYTQDEIKKKIKGNGGLVAYL<br>NTNDAREVEERIEAGDEKAKLVYEAMAYQISKEIGA<br>SAAVLKGDVKAILLTGGIAYSKMFTEMIADRVKFIA<br>DVKVYPGEDEMIALAQGGLRVLTGEEEAQVYDN |
| TesB<br>SEQ ID NO:<br>20 | MSQALKNLLTLLNLEKIEEGLFRGQSEDLGLRQVFG<br>GQVVGQALYAAKETVPEERLVHSFHSYFLRPGDSKK<br>PIIYDVETLRDGNSFSARRVAAIQNGKPIFYMTASFQ<br>APEAGFEHQKTMPSAPAPDGLPSETQIAQSLAHLLPP<br>VLKDKFICDRPLEVRPVEFHNPLKGHVAEPHRQVWI<br>RANGSVPDDLRVHQYLLGYASDLNFLPVALQPHGIG<br>FLEPGIQIATIDHSMWFHRPFNLNEWLLYSVESTSAS<br>SARGFVRGEFYTQDGVLVASTVQEGVMRNHN* |

The gene products of the bcd2, etfA3, and etfB3 genes in *Clostridium difficile* form a complex that converts crotonyl-CoA to butyryl-CoA, which may function as an oxygen-dependent co-oxidant. In some embodiments, because the genetically engineered bacteria of the invention are designed to produce butyrate in a microaerobic or oxygen-limited environment, e.g., the mammalian gut, oxygen dependence could have a negative effect on butyrate production in the gut. It has been shown that a single gene from *Treponema denticola* (ter, encoding trans-2-enoynl-CoA reductase) can functionally replace this three-gene complex in an oxygen-independent manner. In some embodiments, the genetically engineered bacteria comprise a ter gene, e.g., from *Treponema denticola*, which can functionally replace all three of the bcd2, etfB3, and etfA3 genes, e.g., from *Peptoclostridium difficile*. In this embodiment, the genetically engineered bacteria comprise thiA1, hbd, crt2, pbt, and buk, e.g., from *Peptoclostridium difficile*, and ter, e.g., from *Treponema denticola*, and produce butyrate in low-oxygen conditions, in the presence of certain molecules or metabolites, in the presence of molecules or metabolites associated with inflammation or an inflammatory response, or in the presence of some other metabolite that may or may not be present in the gut, such as arabinose.

In some embodiments, the genetically engineered bacteria of the invention comprise thiA1, hbd, crt2, pbt, and buk, e.g., from *Peptoclostridium difficile*; ter, e.g., from *Treponema denticola*; one or more of bcd2, etfB3, and etfA3, e.g., from *Peptoclostridium difficile*; and produce butyrate in low-oxygen conditions, in the presence of certain molecules or metabolites, in the presence of molecules or metabolites associated with inflammation or an inflammatory response, or in the presence of some other metabolite that may or may not be present in the gut, such as arabinose. In some embodiments, one or more of the butyrate biosynthesis genes is functionally replaced, modified, and/or mutated in order to enhance stability and/or increase butyrate production in low-oxygen conditions, in the presence of certain molecules or metabolites, in the presence of molecules or metabolites associated with inflammation or an inflammatory response, or in the presence of some other metabolite that may or may not be present in the gut, such as arabinose.

The gene products of pbt and buk convert butyrylCoA to Butyrate. In some embodiments, the pbt and buk genes can be replaced by a tesB gene. tesB can be used to cleave off the CoA from butyryl-coA. In one embodiment, the genetically engineered bacteria comprise bcd2, etfB3, etfA3, thiA1, hbd, and crt2, e.g., from *Peptoclostridium difficile*, and tesB from *E. Coli* and produce butyrate in low-oxygen conditions, in the presence of molecules or metabolites, in the presence of molecules or metabolites associated with inflammation or an inflammatory response, or in the presence of some other metabolite that may or may not be present in the gut, such as arabinose. In one embodiment, the genetically engineered bacteria comprise ter gene (encoding trans-2-enoynl-CoA reductase) e.g., from *Treponema denticola*, thiA1, hbd, crt2, pbt, and buk, e.g., from *Peptoclostridium difficile*, and tesB from *E. Coli*, and produce butyrate in low-oxygen conditions, in the presence of specific molecules or metabolites, in the presence of molecules or metabolites associated with inflammation or an inflammatory response, or in the presence of some other metabolite that may or may not be present in the gut, such as arabinose. In some embodiments, one or more of the butyrate biosynthesis genes is functionally replaced, modified, and/or mutated in order to enhance stability and/or increase butyrate production in low-oxygen conditions or in the presence of specific molecules or metabolites, or molecules or metabolites associated with condition(s) such as inflammation or an inflammatory response, or in the presence of some other metabolite that may or may not be present in the gut, such as arabinose.

In some embodiments, the local production of butyrate induces the differentiation of regulatory T cells in the gut and/or promotes the barrier function of colonic epithelial cells. In some embodiments, the genetically engineered bacteria comprise genes for aerobic butyrate biosynthesis and/or genes for anaerobic or microaerobic butyrate biosynthesis. In some embodiments, local butyrate production reduces gut inflammation, a symptom of IBD and other gut related disorders.

In one embodiment, the bcd2 gene has at least about 80% identity with SEQ ID NO: 1. In another embodiment, the bcd2 gene has at least about 85% identity with SEQ ID NO: 1. In one embodiment, the bcd2 gene has at least about 90% identity with SEQ ID NO: 1. In one embodiment, the bcd2 gene has at least about 95% identity with SEQ ID NO: 1. In another embodiment, the bcd2 gene has at least about 96%, 97%, 98%, or 99% identity with SEQ ID NO: 1. Accordingly, in one embodiment, the bcd2 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 1. In another embodiment, the bcd2 gene comprises the sequence of SEQ ID NO: 1. In yet another embodiment the bcd2 gene consists of the sequence of SEQ ID NO: 1.

In one embodiment, the etfB3 gene has at least about 80% identity with SEQ ID NO: 2. In another embodiment, the etfB3 gene has at least about 85% identity with SEQ ID NO: 2. In one embodiment, the etfB3 gene has at least about 90% identity with SEQ ID NO: 2. In one embodiment, the etfB3 gene has at least about 95% identity with SEQ ID NO: 2. In another embodiment, the etfB3 gene has at least about 96%, 97%, 98%, or 99% identity with SEQ ID NO: 2. Accordingly, in one embodiment, the etfB3 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 2. In another embodiment, the etfB3 gene comprises the sequence of SEQ ID NO: 2. In yet another embodiment the etfB3 gene consists of the sequence of SEQ ID NO: 2.

In one embodiment, the etfA3 gene has at least about 80% identity with SEQ ID NO: 3. In another embodiment, the etfA3 gene has at least about 85% identity with SEQ ID NO: 3. In one embodiment, the etfA3 gene has at least about 90% identity with SEQ ID NO: 3. In one embodiment, the etfA3 gene has at least about 95% identity with SEQ ID NO: 3. In another embodiment, the etfA3 gene has at least about 96%, 97%, 98%, or 99% identity with SEQ ID NO: 3. Accordingly, in one embodiment, the etfA3 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 3. In another embodiment, the etfA3 gene comprises the sequence of SEQ ID NO: 3. In yet another embodiment the etfA3 gene consists of the sequence of SEQ ID NO: 3.

In one embodiment, the thiA1 gene has at least about 80% identity with SEQ ID NO: 4. In another embodiment, the thiA1 gene has at least about 85% identity with SEQ ID NO: 4. In one embodiment, the thiA1 gene has at least about 90% identity with SEQ ID NO: 4. In one embodiment, the thiA1 gene has at least about 95% identity with SEQ ID NO: 4. In another embodiment, the thiA1 gene has at least about 96%, 97%, 98%, or 99% identity with SEQ ID NO: 4. Accordingly, in one embodiment, the thiA1 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 4. In another embodiment, the thiA1 gene comprises the sequence of SEQ ID NO: 4. In yet another embodiment the thiA1 gene consists of the sequence of SEQ ID NO: 4.

In one embodiment, the hbd gene has at least about 80% identity with SEQ ID NO: 5. In another embodiment, the hbd gene has at least about 85% identity with SEQ ID NO: 5. In one embodiment, the hbd gene has at least about 90% identity with SEQ ID NO: 5. In one embodiment, the hbd gene has at least about 95% identity with SEQ ID NO: 5. In another embodiment, the hbd gene has at least about 96%, 97%, 98%, or 99% identity with SEQ ID NO: 5. Accordingly, in one embodiment, the hbd gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 5. In another embodiment, the hbd gene comprises the sequence of SEQ ID NO: 5. In yet another embodiment the hbd gene consists of the sequence of SEQ ID NO: 5.

In one embodiment, the crt2 gene has at least about 80% identity with SEQ ID NO: 6. In another embodiment, the crt2 gene has at least about 85% identity with SEQ ID NO: 6. In one embodiment, the crt2 gene has at least about 90% identity with SEQ ID NO: 6. In one embodiment, the crt2 gene has at least about 95% identity with SEQ ID NO: 6. In another embodiment, the crt2 gene has at least about 96%, 97%, 98%, or 99% identity with SEQ ID NO: 6. Accordingly, in one embodiment, the crt2 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 6. In another embodiment, the crt2 gene comprises the sequence of SEQ ID NO: 6. In yet another embodiment the crt2 gene consists of the sequence of SEQ ID NO: 6.

In one embodiment, the pbt gene has at least about 80% identity with SEQ ID NO: 7. In another embodiment, the pbt gene has at least about 85% identity with SEQ ID NO: 7. In one embodiment, the pbt gene has at least about 90% identity with SEQ ID NO: 7. In one embodiment, the pbt gene has at least about 95% identity with SEQ ID NO: 7. In another embodiment, the pbt gene has at least about 96%, 97%, 98%, or 99% identity with SEQ ID NO: 7. Accordingly, in one embodiment, the pbt gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 7. In another embodiment, the pbt gene comprises the sequence of SEQ ID NO: 7. In yet another embodiment the pbt gene consists of the sequence of SEQ ID NO: 7.

In one embodiment, the buk gene has at least about 80% identity with SEQ ID NO: 8. In another embodiment, the buk gene has at least about 85% identity with SEQ ID NO: 8. In one embodiment, the buk gene has at least about 90% identity with SEQ ID NO: 8. In one embodiment, the buk gene has at least about 95% identity with SEQ ID NO: 8. In another embodiment, the buk gene has at least about 96%, 97%, 98%, or 99% identity with SEQ ID NO: 8. Accordingly, in one embodiment, the buk gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 8. In another embodiment, the buk gene comprises the sequence of SEQ ID NO: 8. In yet another embodiment the buk gene consists of the sequence of SEQ ID NO: 8.

In one embodiment, the ter gene has at least about 80% identity with SEQ ID NO: 9. In another embodiment, the ter gene has at least about 85% identity with SEQ ID NO: 9. In one embodiment, the ter gene has at least about 90% identity with SEQ ID NO: 9. In one embodiment, the ter gene has at least about 95% identity with SEQ ID NO: 9. In another embodiment, the ter gene has at least about 96%, 97%, 98%, or 99% identity with SEQ ID NO: 9. Accordingly, in one embodiment, the ter gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 9. In another embodiment, the ter gene comprises the sequence of SEQ ID NO: 9. In yet another embodiment the ter gene consists of the sequence of SEQ ID NO: 9.

In one embodiment, the tesB gene has at least about 80% identity with SEQ ID NO: 10. In another embodiment, the tesB gene has at least about 85% identity with SEQ ID NO: 10. In one embodiment, the tesB gene has at least about 90% identity with SEQ ID NO: 10. In one embodiment, the tesB gene has at least about 95% identity with SEQ ID NO: 10. In another embodiment, the tesB gene has at least about 96%, 97%, 98%, or 99% identity with SEQ ID NO: 10. Accordingly, in one embodiment, the tesB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 10. In another embodiment, the tesB gene comprises the sequence of SEQ ID NO: 10. In yet another embodiment the tesB gene consists of the sequence of SEQ ID NO: 10.

In one embodiment, one or more polypeptides encoded by the butyrate circuits and expressed by the genetically engineered bacteria have at least about 80% identity with one or more of SEQ ID NO: 11 through SEQ ID NO: 20. In another embodiment, one or more polypeptides encoded by the butyrate circuits and expressed by the genetically engineered bacteria have at least about 85% identity with one or more of SEQ ID NO: 11 through SEQ ID NO: 20. In one embodiment, one or more polypeptides encoded by the butyrate circuits and expressed by the genetically engineered bacteria have at least about 90% identity with one or more of SEQ ID NO: 11 through SEQ ID NO: 20. In one embodiment, one or more polypeptides encoded by the butyrate circuits and expressed by the genetically engineered bacteria have at least about 95% identity with one or more of SEQ ID NO: 11 through SEQ ID NO: 20. In another embodiment, one or more polypeptides encoded by the butyrate circuits and expressed by the genetically engineered bacteria have at least about 96%, 97%, 98%, or 99% identity with one or more of SEQ ID NO: 11 through SEQ ID NO: 20. Accordingly, in one embodiment, one or more polypeptides encoded by the butyrate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 11 through SEQ ID NO: 20. In another embodiment, one or more polypeptides encoded by the butyrate circuits and expressed by the genetically engineered bacteria one or more polypeptides encoded by the butyrate circuits and expressed by the genetically engineered bacteria comprise the sequence of with one or more of SEQ ID NO: 11 through SEQ ID NO: 20. In yet another embodiment one or more polypeptides encoded by the butyrate circuits and expressed by the genetically engineered bacteria consist of the sequence of with one or more of SEQ ID NO: 11 through SEQ ID NO: 20.

In some embodiments, one or more of the butyrate biosynthesis genes is a synthetic butyrate biosynthesis gene. In some embodiments, one or more of the butyrate biosynthesis genes is a *Treponema denticola* butyrate biosynthesis gene. In some embodiments, one or more of the butyrate biosynthesis genes is a *C. glutamicum* butyrate biosynthesis gene. In some embodiments, one or more of the butyrate biosynthesis genes is a *Peptoclostridicum difficile* butyrate biosynthesis gene. The butyrate gene cassette may comprise genes for the aerobic biosynthesis of butyrate and/or genes for the anaerobic or microaerobic biosynthesis of butyrate.

In some embodiments, the genetically engineered bacteria comprise a combination of butyrate biosynthesis genes from different species, strains, and/or substrains of bacteria, and are capable of producing butyrate. In some embodiments, one or more of the butyrate biosynthesis genes is functionally replaced, modified, and/or mutated in order to enhance stability and/or increase butyrate production. In some embodiments, the local production of butyrate reduces food intake and ameliorates improves gut barrier function and reduces inflammation. In some embodiments, the genetically engineered bacteria are capable of expressing the butyrate biosynthesis cassette and producing butyrate in low-oxygen conditions, in the presence of certain molecules or metabolites, in the presence of molecules or metabolites associated with inflammation or an inflammatory response, or in the presence of some other metabolite that may or may not be present in the gut, such as arabinose.

In one embodiment, the butyrate gene cassette is directly operably linked to a first promoter. In another embodiment, the butyrate gene cassette is indirectly operably linked to a first promoter. In one embodiment, the promoter is not operably linked with the butyrate gene cassette in nature.

In some embodiments, the butyrate gene cassette is expressed under the control of a constitutive promoter. In another embodiment, the butyrate gene cassette is expressed under the control of an inducible promoter. In some embodiments, the butyrate gene cassette is expressed under the control of a promoter that is directly or indirectly induced by exogenous environmental conditions. In one embodiment, the butyrate gene cassette is expressed under the control of a promoter that is directly or indirectly induced by low-oxygen or anaerobic conditions, wherein expression of the butyrate gene cassette is activated under low-oxygen or anaerobic environments, such as the environment of the mammalian gut. Inducible promoters are described in more detail infra.

The butyrate gene cassette may be present on a plasmid or chromosome in the bacterial cell. In one embodiment, the butyrate gene cassette is located on a plasmid in the bacterial cell. In another embodiment, the butyrate gene cassette is located in the chromosome of the bacterial cell. In yet another embodiment, a native copy of the butyrate gene cassette is located in the chromosome of the bacterial cell, and a butyrate gene cassette from a different species of bacteria is located on a plasmid in the bacterial cell. In yet another embodiment, a native copy of the butyrate gene cassette is located on a plasmid in the bacterial cell, and a butyrate gene cassette from a different species of bacteria is located on a plasmid in the bacterial cell. In yet another embodiment, a native copy of the butyrate gene cassette is located in the chromosome of the bacterial cell, and a butyrate gene cassette from a different species of bacteria is located in the chromosome of the bacterial cell.

In some embodiments, the butyrate gene cassette is expressed on a low-copy plasmid. In some embodiments, the butyrate gene cassette is expressed on a high-copy plasmid. In some embodiments, the high-copy plasmid may be useful for increasing expression of butyrate.

Propionate

In alternate embodiments, the genetically engineered bacteria of the invention are capable of producing an anti-inflammatory or gut barrier enhancer molecule, e.g., propionate, that is synthesized by a biosynthetic pathway requiring multiple genes and/or enzymes.

In some embodiments, the genetically engineered bacteria of the invention comprise a propionate gene cassette and are capable of producing propionate under particular exogenous environmental conditions. The genetically engineered bacteria may express any suitable set of propionate biosynthesis genes (see, e.g., Table 4, Table 5, Table 6, Table 7). Unmodified bacteria that are capable of producing propionate via an endogenous propionate biosynthesis pathway include, but are not limited to, *Clostridium propionicum*, *Megasphaera elsdenii*, and *Prevotella ruminicola*. In some embodiments, the genetically engineered bacteria of the invention comprise propionate biosynthesis genes from a different species, strain, or substrain of bacteria. In some embodiments, the genetically engineered bacteria comprise the genes pct, lcd, and acr from *Clostridium propionicum*. In some embodiments, the genetically engineered bacteria comprise acrylate pathway genes for propionate biosynthesis, e.g., pct, lcdA, lcdB, lcdC, etfA, acrB, and acrC. In some embodiments, the rate limiting step catalyzed by the Acr enzyme, is replaced by the AcuI from *R. sphaeroides*, which catalyzes the NADPH-dependent acrylyl-CoA reduction to produce propionyl-CoA. Thus the propionate cassette comprises pct, lcdA, lcdB, lcdC, and acuI. In another embodiment, the homolog of AcuI in *E coli*, yhdH is used. This the propionate cassette comprises pct, lcdA, lcdB, lcdC, and yhdH. In alternate embodiments, the genetically engineered bacteria comprise pyruvate pathway genes for propionate biosynthesis, e.g., thrA$^{fbr}$, thrB, thrC, ilvA$^{fbr}$, aceE, aceF, and lpd, and optionally further comprise tesB. In another embodiment, the propionate gene cassette comprises the genes of the Sleepting Beauty Mutase operon, e.g., from *E. coli* (sbm, ygfD, ygfG, ygfH). The SBM pathway is cyclical and composed of a series of biochemical conversions forming propionate as a fermentative product while regenerating the starting molecule of succinyl-CoA. Sbm converts succinyl CoA to L-methylmalonylCoA, ygfG converts L-methylmalonylCoA into PropionylCoA, and ygfH converts propionyl-CoA into propionate and succinate into succinylCoA.

This pathway is very similar to the oxidative propionate pathway of Propionibacteria, which also converts succinate to propionate. Succinyl-CoA is converted to R-methylmalonyl-CoA by methylmalonyl-CoA mutase (mutAB). This is in turn converted to S-methylmalonyl-CoA via methymalonyl-CoA epimerase (GI:18042134). There are three genes which encode methylmalonyl-CoA carboxytransferase (mmdA, PFREUD_18870, bccp) which converts methylmalonyl-CoA to propionyl-CoA.

The genes may be codon-optimized, and translational and transcriptional elements may be added. Table 4-6 lists the nucleic acid sequences of exemplary genes in the propionate biosynthesis gene cassette. Table 7 lists the polypeptide sequences expressed by exemplary propionate biosynthesis genes.

TABLE 4

Propionate Cassette Sequences (Acrylate Pathway)

| Gene sequence | Description |
|---|---|
| pct<br>SEQ ID NO: 21 | ATGCGCAAAGTGCCGATTATCACGGCTGACGAGGCCGCAAAAC<br>TGATCAAGGACGGCGACACCGTGACAACTAGCGGCTTTGTGGGT<br>AACGCGATCCCTGAGGCCCTTGACCGTGCAGTCGAAAAGCGTTT<br>CCTGGAAACGGGCGAACCGAAGAACATTACTTATGTATATTGCG<br>GCAGTCAGGGCAATCGCGACGGTCGTGGCGCAGAACATTTCGC<br>GCATGAAGGCCTGCTGAAACGTTATATCGCTGGCCATTGGGCGA<br>CCGTCCCGGCGTTAGGGAAAATGGCCATGGAGAATAAAATGGA<br>GGCCTACAATGTCTCTCAGGGCGCCTTGTGTCATCTCTTTCGCGA<br>TATTGCGAGCCATAAACCGGGTGTGTTCACGAAAGTAGGAATCG<br>GCACCTTCATTGATCCACGTAACGGTGGTGGGAAGGTCAACGAT<br>ATTACCAAGGAAGATATCGTAGAACTGGTGGAAATTAAAGGGC<br>AGGAATACCTGTTTTATCCGGCGTTCCCGATCCATGTCGCGCTG<br>ATTCGTGGCACCTATGCGGACGAGAGTGGTAACATCACCTTTGA<br>AAAAGAGGTAGCGCCTTTGGAAGGGACTTCTGTCTGTCAAGCGG<br>TGAAGAACTCGGGTGGCATTGTCGTGGTTCAGGTTGAGCGTGTC<br>GTCAAAGCAGGCACGCTGGATCCGCGCCATGTGAAAGTTCCGG<br>GTATCTATGTAGATTACGTAGTCGTCGCGGATCCGGAGGACCAT<br>CAACAGTCCCTTGACTGCGAATATGATCCTGCCCTTAGTGGAGA<br>GCACCGTCGTCCGGAGGTGGTGGGTGAACCACTGCCTTTATCCG<br>CGAAGAAAGTCATCGGCCGCCGTGGCGCGATTGAGCTCGAGAA<br>AGACGTTGCAGTGAACCTTGGGGTAGGTGCACCTGAGTATGTGG<br>CCTCCCGTGGCCGATGAAGAAGGCATTGTGGATTTTATGACTCTC<br>ACAGCGGAGTCCGGCGCTATCGGTGGCGTTCCAGCCGGCGGTGT<br>TCGCTTTGGGGCGAGCTACAATGCTGACGCCTTGATCGACCAGG<br>GCTACCAATTTGATTATTACGACGGTGGGGGTCTGGATCTTTGTT<br>ACCTGGGTTTAGCTGAATGCGACGAAAAGGGTAATATCAATGTT<br>AGCCGCTTCGGTCCTCGTATCGCTGGGTGCGGCGGATTCATTAA<br>CATTACCCAAAACACGCCGAAAGTCTTCTTTTGTGGGACCTTTA<br>CAGCCGGGGGCTGAAAGTGAAAATTGAAGATGGTAAGGTGAT<br>TATCGTTCAGGAAGGGAAACAGAAGAAATTCCTTAAGGCAGTG<br>GAGCAAATCACCTTTAATGGAGACGTGGCCTTAGCGAACAAGC<br>AACAAGTTACCTACATCACGGAGCGTTGCGTCTTCCTCCTCAAA<br>GAAGACGGTTTACACCTTTCGGAAATCGCGCCAGGCATCGATCT<br>GCAGACCCAGATTTTGGATGTTATGGACTTTGCCCCGATCATTG<br>ATCGTGACGCAAACGGGCAGATTAAACTGATGGACGCGGCGTT<br>ATTCGCAGAAGGGCTGATGGGCTTGAAAGAAATGAAGTCTTAA |
| lcdA<br>SEQ ID NO: 22 | ATGAGCTTAACCCAAGGCATGAAAGCTAAACAACTGTTAGCAT<br>ACTTTCAGGGTAAAGCCGATCAGGATGCACGTGAAGCGAAAGC<br>CCGCGGTGAGCTGGTCTGCTGGTCGGCGTCAGTCGCGCCGCCGG<br>AATTTTGCGTAACAATGGGCATTGCCATGATCTACCCGGAGACT<br>CATGCAGCGGGCATCGGTGCCCGCAAAGGTGCGATGGACATGC<br>TGGAAGTTGCGGACCGCAAAGGCTACAACGTGGATTGTTGTTCC<br>TACGGCCGTGTAAATATGGGTTACATGGAATGTTTAAAAGAAGC<br>CGCCATCACGGGCGTCAAGCCGGAAGTTTTGGTTAATTCCCCTG<br>CTGCTGACGTTCCGCTTCCCGATTTGGTGATTACGTGTAATAATA<br>TCTGTAACACGCTGCTGAAATGGTACGAAAACTTAGCAGCAGA<br>ACTCGATATTCCTTGCATCGTGATCGACGTACCGTTTAATCATAC<br>CATGCCGATTCCGGAATATGCCAAGGCCTACATCGCGGACCAGT<br>TCCGCAATGCAATTTCTCAGCTGGAAGTTATTTGTGGCCGTCCGT<br>TCGATTGGAAGAAATTTAAGGAGGTCAAAGATCAGACCCAGCG<br>TAGCGTATACCACTGGAACCGCATTGCCGAGATGGCGAAATAC<br>AAGCCTAGCCCGCTGAACGGCTTCGATCTGTTCAATTACATGGC<br>GTTAATCGTGGCGTGCCGCAGCCTGGATTATGCAGAAATTACCT<br>TTAAAGCGTTCGCGGACGAATTAGAAGAGAATTTGAAGGCGGG<br>TATCTACGCCTTTAAAGGTGCGGAAAAAACGCGCTTTCAATGGG<br>AAGGTATCGCGGTGTGGCCACATTTAGGTCACACGTTTAAATCT<br>ATGAAGAATCTGAATTCGATTATGACCGGTACGGCATACCCCGC<br>CCTTTGGGACCTGCACTATGACGCTAACGACGAATCTATGCACT<br>CTATGGCTGAAGCGTACACCCGTATTTATATTAATACTTGTCTGC<br>AGAACAAAGTAGAGGTCCTGCTTGGGATCATGGAAAAAGGCCA<br>GGTGGATGGTACCGTATATCATCTGAATCGCAGCTGCAAACTGA<br>TGAGTTTCCTGAACGTGGAAACGGCTGAAATTATTAAAGAGAA<br>GAACGGTCTTCCTTACGTCTCCATTGATGGCGATCAGACCGATC |

TABLE 4-continued

Propionate Cassette Sequences (Acrylate Pathway)

| Gene sequence | Description |
|---|---|
| | CTCGCGTTTTTTCTCCGGCCCAGTTTGATACCCGTGTTCAGGCCC TGGTTGAGATGATGGAGGCCAATATGGCGGCAGCGGAATAA |
| lcdB SEQ ID NO: 23 | ATGTCACGCGTGGAGGCAATCCTGTCGCAGCTGAAAGATGTCGC CGCGAATCCGAAAAAAGCCATGGATGACTATAAAGCTGAAACA GGTAAGGGCGCGGTTGGTATCATGCCGATCTACAGCCCCGAAG AAATGGTACACGCCGCTGGCTATTTGCCGATGGGAATCTGGGGC GCCCAGGGCAAAACGATTAGTAAAGCGCGCACCTATCTGCCTGC TTTTGCCTGCAGCGTAATGCAGCAGGTTATGGAATTACAGTGCG AGGGCGCGTATGATGACCTGTCCGCAGTTATTTTTAGCGTACCG TGCGACACTCTCAAATGTCTTAGCCAGAAATGGAAAGGTACGTC CCCAGTGATTGTATTTACGCATCCGCAGAACCGCGGATTAGAAG CGGCGAACCAATTCTTGGTTACCGAGTATGAACTGGTAAAAGCA CAACTGGAATCAGTTCTGGGTGTGAAAATTTCAAACGCCGCCCT GGAAAATTCGATTGCAATTTATAACGAGAATCGTGCCGTGATGC GTGAGTTCGTGAAAGTGGCAGCGGACTATCCTCAAGTCATTGAC GCAGTGAGCCGCCACGCGGTTTTTAAAGCGCCAGTTTATGCT TAAGGAAAAACATACCGCACTTGTGAAAGAACTGATCGCTGAG ATTAAAGCAACGCCAGTCCAGCCGTGGGACGGAAAAAAGGTTG TAGTGACGGGCATTCTGTTGGAACCGAATGAGTTATTAGATATC TTTAATGAGTTTAAGATCGCGATTGTTGATGATGATTTAGCGCA GGAAAGCCGTCAGATCCGTGTTGACGTTCTGGACGGAGAAGGC GGACCGCTCTACCGTATGGCTAAAGCGTGGCAGCAAATGTATGG CTGCTCGCTGGCAACCGACACCAAGAAGGGTCGCGGCCGTATGT TAATTAACAAAACGATTCAGACCGGTGCGGACGCTATCGTAGTT GCAATGATGAAGTTTTGCGACCCAGAAGAATGGGATTATCCGGT AATGTACCGTGAATTTGAAGAAAAGGGGTCAAATCACTTATG ATTGAGGTGGATCAGGAAGTATCGTCTTTCGAACAGATTAAAAC CCGTCTGCAGTCATTCGTCGAAATGCTTTAA |
| lcdC SEQ ID NO: 24 | ATGTATACCTTGGGGATTGATGTCGGTTCTGCCTCTAGTAAAGC GGTGATTCTGAAAGATGGAAAAGATATTGTCGCTGCCGAGGTTG TCCAAGTCGGTACCGGCTCCTCGGGTCCCCAACGCGCACTGGAC AAAGCCTTTGAAGTCTCTGGCTTAAAAAAGGAAGACATCAGCTA CACAGTAGCTACGGGCTATGGGCGCTTCAATTTTAGCGACGCGG AAACAGATTTCGGAAATTAGCTGTCATGCCAAAGGCATTTAT TTCTTAGTACCAACTGCGCGCACTATTATTGACATTGGCGGCCA AGATGCGAAAGCCATCCGCCTGGACGACAAGGGGGGTATTAAG CAATTCTTCATGAATGATAAATGCGCGGCGGGCACGGGGCGTTT CCTGGAAGTCATGGCTCGCGTACTTGAAACCACCCTGGATGAAA TGGCTGAACTGGATGAACAGGCGACTGACACCGCTCCCATTCA AGCACCTGCACGGTTTTCGCCGAAAGCGAAGTAATTAGCCAATT GAGCAATGGTGTCTCACGCAACAACATCATTAAAGGTGTCCATC TGAGCGTTGCGTCACGTCGTGTGGTCTGGCGTATCGCGGCGGT TTGGAGAAAGATGTTGTTATGACAGGTGGCGTGGCAAAAAATG CAGGGGTGGTGCGCGCGGTGGCGGGCGTTCTGAAGACCGATGT TATCGTTGCTCCGAATCCTCAGACGACCGGTGCACTGGGGGCAG CGCTGTATGCTTATGAGGCCGCCCAGAAGAAGTA |
| etfA SEQ ID NO: 25 | ATGGCCTTCAATAGCGCAGATATTAATTCTTTCCGCGATATTTGG GTGTTTTGTGAACAGCGTGAGGGCAAACTGATTAACACCGATTT CGAATTAATTAGCGAAGGTCGTAAACTGGCTGACGAACGCGGA AGCAAACTGGTTGGAATTTTGCTGGGGCACGAAGTTGAAGAAA TCGCAAAAGAATTAGGCGGCTATGGTGCGGACAAGGTAATTGT GTGCGATCATCCGGAACTTAAATTTTACACTACGGATGCTTATG CCAAAGTTTTATGTGACGTCGTGATGGAAGAGAAACCGGAGGT AATTTTGATCGGTGCCACCAACATTGGCCGTGATCTCGGACCGC GTTGTGCTGCACGCTTGCACACGGGGCTGACGGCTGATTGCACG CACCTGGATATTGATATGAATAAATATGTGGACTTTCTTAGCAC CAGTAGCACCTTGGATATCTCGTCGATGACTTTCCCTATGGAAG ATACAAACCTTAAAATGACGCGCCCTGCATTTGGCGGACATCTG ATGGCAACGATCATTTGTCCACGCTTCCGTCCCTGTATGAGCAC AGTGCGCCCCGGAGTGATGAAGAAAGCGGAGTTCTCGCAGGAG ATGGCGCAAGCATGTCAAGTAGTGACCCGTCACGTAAATTTGTC GGATGAAGACCTTAAAACTAAAGTAATTAATATCGTGAAGGAA ACGAAAAAGATTGTGGATCTGATCGGCGCAGAAATTATTGTGTC AGTTGGTCGTGGTATCTCGAAAGATGTCCAAGGTGGAATTGCAC TGGCTGAAAAACTTGCGGACGCATTTGGTAACGGTGTCGTGGGC GGCTCGCGCGCAGTGATTGATTCCGGCTGGTTACCTGCGGATCA TCAGGTTGGACAAACCGGTAAGACCGTGCACCCGAAAGTCTAC GTGGCGCTGGGTATTAGTGGGGCTATCCAGCATAAGGCTGGGAT GCAAGACTCTGAACTGATCATTGCCGTCAACAAAGACGAAACG GCGCCTATCTTCGACTGCGCCGATTATGGCATCACCGGTGATTT ATTTAAAATCGTACCGATGATGATCGACGCGATCAAAGAGGGT AAAAACGCATGA |

TABLE 4-continued

Propionate Cassette Sequences (Acrylate Pathway)

| Gene sequence | Description |
|---|---|
| acrB<br>SEQ ID NO: 26 | ATGCGCATCTATGTGTGTGTGAAACAAGTCCCAGATACGAGCGG<br>CAAGGTGGCCGTTAACCCTGATGGGACCCTTAACCGTGCCTCAA<br>TGGCAGCGATTATTAACCCGGACGATATGTCCGCGATCGAACAG<br>GCATTAAAACTGAAAGATGAAACCGGATGCCAGGTTACGGCGC<br>TTACGATGGGTCCTCCTCCTGCCGAGGGCATGTTGCGCGAAATT<br>ATTGCAATGGGGGCCGACGATGGTGTGCTGATTTCGGCCCGTGA<br>ATTTGGGGGGTCCGATACCTTCGCAACCAGTCAAATTATTAGCG<br>CGGCAATCCATAAATTAGGCTTAAGCAATGAAGACATGATCTTT<br>TGCGGTCGTCAGGCCATTGACGGTGATACGGCCCAAGTCGGCCC<br>TCAAATTGCCGAAAAACTGAGCATCCCACAGGTAACCTATGGCG<br>CAGGAATCAAAAAATCTGGTGATTTAGTGCTGGTGAAGCGTATG<br>TTGGAGGATGGTTATATGATGATCGAAGTCGAAACTCCATGTCT<br>GATTACCTGCATTCAGGATAAAGCGGTAAAACCACGTTACATGA<br>CTCTCAACGGTATTATGGAATGCTACTCCAAGCCGCTCCTCGTTC<br>TCGATTACGAAGCACTGAAAGATGAACCGCTGATCGAACTTGAT<br>ACCATTGGGCTTAAAGGCTCCCCGACGAATATCTTTAAATCGTT<br>TACGCCGCCTCAGAAAGGCGTTGGTGTCATGCTCCAAGGCACCG<br>ATAAGGAAAAAGTCGAGGATCTGGTGGATAAGCTGATGCAGAA<br>ACATGTCATCTAA |
| acrC<br>SEQ ID NO: 27 | ATGTTCTTACTGAAGATTAAAAAAGAACGTATGAAACGCATGG<br>ACTTTAGTTTAACGCGTGAACAGGAGATGTTAAAAAAACTGGCG<br>CGTCAGTTTGCTGAGATCGAGCTGGAACCGGTGGCCGAAGAGA<br>TTGATCGTGAGCACGTTTTTCCTGCAGAAAACTTTAAGAAGATG<br>GCGGAAATTGGCTTAACCGGCATTGGTATCCCGAAAGAATTTGG<br>TGGCTCCGGTGGAGGCACCCTGGAGAAGGTCATTGCCGTGTCAG<br>AATTCGGCAAAAAGTGTATGGCCTCAGCTTCCATTTTAAGCATT<br>CATCTTATCGCGCCGCAGGCAATCTACAAATATGGGACCAAAGA<br>ACAGAAAGAGACGTACCTGCCGCGTCTTACCAAAGGTGGTGAA<br>CTGGGCGCCTTTGCGCTGACAGAACCAAACGCCGGAAGCGATG<br>CCGGCGCGGTAAAAACGACCGCGATTCTGGACAGCCAGACAAA<br>CGAGTACGTGCTGAATGGCACCAAATGCTTTATCAGCGGGGGCG<br>GGCGCGCGGGTGTTCTTGTAATTTTTGCGCTTACTGAACCGAAA<br>AAAGGTCTGAAAGGGATGAGCGCGATTATCGTGGAGAAAGGGA<br>CCCCGGGCTTCAGCATCGGCAAGGTGGAGAGCAAGATGGGGAT<br>CGCAGGTTCGGAAACCGCGGAACTTATCTTCGAAGATTGTCGCG<br>TTCCGGCTGCCAACCTTTTAGGTAAAGAAGGCAAAGGCTTTAAA<br>ATTGCTATGGAAGCCCTGGATGGCGCCCGTATTGGCGTGGGCGC<br>TCAAGCAATCGGAATTGCCGAGGGGGCGATCGACCTGAGTGTG<br>AAGTACGTTCACGAGCGCATTCAATTTGGTAAACCGATCGCGAA<br>TCTGCAGGGAATTCAATGGTATATCGCGGATATGGCGACCAAAA<br>CCGCCGCGGCCACGCGCACTTGTTGAGTTTGCAGCGTATCTTGAA<br>GACGCGGGTAAACCGTTCACAAAGGAATCTGCTATGTGCAAGCT<br>GAACGCCTCCGAAAACGCGCGTTTTGTGACAAATTTAGCTCTGC<br>AGATTCACGGGGGTTACGGTTATATGAAAGATTATCCGTTAGAG<br>CGTATGTATCGCGATGCTAAGATTACGGAAATTTACGAGGGGAC<br>ATCAGAAATCCATAAGGTGGTGATTGCGCGTGAAGTAATGAAA<br>CGCTAA |
| thrA$^{fbr}$<br>SEQ ID NO: 28 | ATGCGAGTGTTGAAGTTCGGCGGTACATCAGTGGCAAATGCAG<br>AACGTTTTCTGCGTGTTGCCGATATTCTGGAAAGCAATGCCAGG<br>CAGGGGCAGGTGGCCACCGTCCTCTCTGCCCCCGCCAAAATCAC<br>CAACCACCTGGTGGCGATGATTGAAAAAACCATTAGCGGCCAG<br>GATGCTTTACCCAATATCAGCGATGCCGAACGTATTTTTGCCGA<br>ACTTTTGACGGGACTCGCCGCCGCCCAGCCGGGGTTCCCGCTGG<br>CGCAATTGAAAACTTTCGTCGATCAGGAATTTGCCCAAATAAAA<br>CATGTCCTGCATGGCATTAGTTTGTTGGGGCAGTGCCCGGATAG<br>CATCAACGCTGCGCTGATTTGCCGTGGCGAGAAAATGTCGATCG<br>CCATTATGGCCGGCGTATTAGAAGCGCGCGGTCACAACGTTACT<br>GTTATCGATCCGGTCGAAAAACTGCTGGCAGTGGGGCATTACCT<br>CGAATCTACCGTCGATATTGCTGAGTCCACCCGCCGTATTGCGG<br>CAAGCCGCATTCCGGCTGATCACATGGTGCTGATGGCAGGTTTC<br>ACCGCCGGTAATGAAAAAGGCGAACTGGTGGTCTTGGACGCA<br>ACGGTTCCGACTACTCTGCTGCGGTGCTGGCTGCCTGTTTACGC<br>GCCGATTGTTGCGAGATTTGGACGGACGTTGACGGGGTCTATAC<br>CTGCGACCCGCGTCAGGTGCCCGATGCGAGGTTGTTGAAGTCGA<br>TGTCCTACCAGGAAGCGATGGAGCTTTCCTACTTCGGCGCTAAA<br>GTTCTTCACCCCCGCACCATTACCCCCATCGCCCAGTTCCAGATC<br>CCTTGCCTGATTAAAAATACCGGAAATCCTCAAGCACCAGGTAC<br>GCTCATTGGTGCCAGCCGTGATGAAGACGAATTACCGGTCAAGG<br>GCATTTCCAATCTGAATAACATGGCAATGTTCAGCGTTTCTGGT<br>CCGGGGATGAAAGGGATGGTCGGCATGGCGGCGCGTCTTTG<br>CAGCGATGTCACGCGCCCGTATTTCCGTGGTGCTGATTACGCAA<br>TCATCTTCCGAATACAGCATCAGTTTCTGCGTTCCACAAAGCGA<br>CTGTGTGCGAGCTGAACGGGCAATGCAGGAAGAGTTCTACCTG<br>GAACTGAAAGAAGGCTTACTGGAGCCGCTGGCAGTGACGGAAC |

TABLE 4-continued

Propionate Cassette Sequences (Acrylate Pathway)

| Gene sequence | Description |
|---|---|
| | GGCTGGCCATTATCTCGGTGGTAGGTGATGGTATGCGCACCTTG<br>CGTGGGATCTCGGCGAAATTCTTTGCCGCACTGGCCCGCGCCAA<br>TATCAACATTGTCGCCATTGCTCAGAGATCTTCTGAACGCTCAA<br>TCTCTGTCGTGGTAAATAACGATGATGCGACCACTGGCGTGCGC<br>GTTACTCATCAGATGCTGTTCAATACCGATCAGGTTATCGAAGT<br>GTTTGTGATTGGCGTCGGTGGCGTTGGCGGTGCGCTGCTGGAGC<br>AACTGAAGCGTCAGCAAAGCTGGCTGAAGAATAAACATATCGA<br>CTTACGTGTCTGCGGTGTTGCCAACTCGAAGGCTCTGCTCACCA<br>ATGTACATGGCCTTAATCTGGAAAACTGGCAGGAAGAACTGGC<br>GCAAGCCAAAGAGCCGTTTAATCTCGGGCGCTTAATTCGCCTCG<br>TGAAAGAATATCATCTGCTGAACCCGGTCATTGTTGACTGCACT<br>TCCAGCCAGGCAGTGGCGGATCAATATGCCGACTTCCTGCGCGA<br>AGGTTTCCACGTTGTCACGCCGAACAAAAGGCCAACACCTCGT<br>CGATGGATTACTACCATCAGTTGCGTTATGCGGCGGAAAAATCG<br>CGGCGTAAATTCCTCTATGACACCAACGTTGGGGCTGGATTACC<br>GGTTATTGAGAACCTGCAAAATCTGCTCAATGCAGGTGATGAAT<br>TGATGAAGTTCTCCGGCATTCTTTCTGGTTCGCTTTCTTATATCTT<br>CGGCAAGTTAGACGAAGGCATGAGTTTCTCCGAGGCGACCACG<br>CTGGCGCGGGAAATGGGTTATACCGAACCGGACCCGCGAGATG<br>ATCTTTCTGGTATGGATGTGGCGCGTAAACTATTGATTCTCGCTC<br>GTGAAACGGGACGTGAACTGGAGCTGGCGGATATTGAAATTGA<br>ACCTGTGCTGCCCGCAGAGTTTAACGCCGAGGGTGATGTTGCCG<br>CTTTTATGGCGAATCTGTCACAACTGACGATCTCTTTGCCGCGC<br>GCGTGGCGAAGGCCCGTGATGAAGGAAAAGTTTTGCGCTATGTT<br>GGCAATATTGATGAAGATGGCGTCTGCCGCGTGAAGATTGCCGA<br>AGTGGATGGTAATGATCCGCTGTTCAAAGTGAAAAATGGCGAA<br>AACGCCCTGGCCTTCTATAGCCACTATTATCAGCCGCTGCCGTT<br>GGTACTGCGCGGATATGGTGCGGGCAATGACGTTACAGCTGCCG<br>GTGTCTTTGCTGATCTGCTACGTACCCTCTCATGGAAGTTAGGA<br>GTCTGA |
| thrB<br>SEQ ID NO: 29 | ATGGTTAAAGTTTATGCCCCGGCTTCCAGTGCCAATATGAGCGT<br>CGGGTTTGATGTGCTCGGGGCGGCGGTGACACCTGTTGATGGTG<br>CATTGCTCGGAGATGTAGTCACGGTTGAGGCGGCAGAGACATTC<br>AGTCTCAACAACCTCGGACGCTTTGCCGATAAGCTGCCGTCAGA<br>ACCACGGGAAAATATCGTTTATCAGTGCTGGGAGCGTTTTTGCC<br>AGGAACTGGGTAAGCAAATTCCAGTGGCGATGACCCTGGAAAA<br>GAATATGCCGATCGGTTCGGGCTTAGGCTCCAGTGCCTGTTCGG<br>TGGTCGCGGCGCTGATGGCGATGAATGAACACTGCGGCAAGCC<br>GCTTAATGACACTCGTTTGCTGGCTTTGATGGGCGAGCTGGAAG<br>GCCGTATCTCCGGCAGCATTCATTACGACAACGTGGCACCGTGT<br>TTTCTCGGTGGTATGCAGTTGATGATCGAAGAAAACGACATCAT<br>CAGCCAGCAAGTGCCAGGGTTTGATGAGTGGCTGTGGGTGCTGG<br>CGTATCCGGGGATTAAAGTCTCGACGGCAGAAGCCAGGGCTATT<br>TTACCGGCGCAGTATCGCCGCCAGGATTGCATTGCGCACGGGCG<br>ACATCTGGCAGGCTTCATTCACGCCTGCTATTCCCGTCAGCCTG<br>AGCTTGCCGCGAAGCTGATGAAAGATGTTATCGCTGAACCCTAC<br>CGTGAACGGTTACTGCCAGGCTTCCGGCAGGCGCGGCAGGCGG<br>TCGCGGAAATCGGCGCGGTAGCGAGCGGTATCTCCGGCTCCGGC<br>CCGACCTTGTTCGCTCTGTGTGACAAGCCGGAAACCGCCCAGCG<br>CGTTGCCGACTGGTTGGGTAAGAACTACCTGCAAAATCAGGAA<br>GGTTTTGTTCATATTTGCCGGCTGGATACGGCGGGCGCACGAGT<br>ACTGGAAAACTAA |
| thrC<br>SEQ ID NO: 30 | ATGAAACTCTACAATCTGAAAGATCACAACGAGCAGGTCAGCTT<br>TGCGCAAGCCGTAACCCAGGGGTTGGGCAAAAATCAGGGGCTG<br>TTTTTTCCGCACGACCTGCCGGAATTCAGCCTGACTGAAATTGA<br>TGAGATGCTGAAGCTGGATTTTGTCACCCGCAGTGCGAAGATCC<br>TCTCGGCGTTTATTGGTGATGAAATCCCACAGGAAATCCTGGAA<br>GAGCGCGTGCGCGCGGCGTTTGCCTTCCCGGCTCCGGTCGCCAA<br>TGTTGAAAGCGATGTCGGTTGTCTGGAATTGTTCCACGGGCCAA<br>CGCTGGCATTTAAAGATTTCGGCGGTCGCTTTATGGCACAAATG<br>CTGACCCATATTGCGGGTGATAAGCCAGTGACCATTCTGACCGC<br>GACCTCCGGTGATACCGGAGCGGCAGTGGCTCATGCTTTCTACG<br>GTTTACCGAATGTGAAAGTGGTTATCCTCTATCCACGAGGCAAA<br>ATCAGTCCACTGCAAGAAAAACTGTTCTGTACATTGGGCGGCAA<br>TATCGAAACTGTTGCCATCGACGGCGATTTCGATGCCTGTCAGG<br>CGCTGGTGAAGCAGGCGTTTGATGATGAAGAACTGAAAGTGGC<br>GCTAGGGTTAAACTCGGCTAACTCGATTAACATCAGCCGTTTGC<br>TGGCGCAGATTTGCTACTACTTTGAAGCTGTTGCGCAGCTGCCG<br>CAGGAGACGCGCAACCAGCTGGTTGTCTCGGTGCCAAGCGGAA<br>ACTTCGGCGATTTGACGGCGGGTCTGCTGGCGAAGTCACTCGGT<br>CTGCCGGTGAAACGTTTTATTGCTGCGACCAACGTGAACGATAC<br>CGTGCCACGTTTCCTGCACGACGGTCAGTGGTCACCCAAAGCGA<br>CTCAGGCGACGTTATCCAACGCGATGGACGTGAGTCAGCCGAA<br>CAACTGGCCGCGTGTGGAAGAGTTGTTCCGCCGCAAAATCTGGC |

TABLE 4-continued

Propionate Cassette Sequences (Acrylate Pathway)

| Gene sequence | Description |
|---|---|
| | AACTGAAAGAGCTGGGTTATGCAGCCGTGGATGATGAAACCAC<br>GCAACAGACAATGCGTGAGTTAAAAGAACTGGGCTACACTTCG<br>GAGCCGCACGCTGCCGTAGCTTATCGTGCGCTGCGTGATCAGTT<br>GAATCCAGGCGAATATGGCTTGTTCCTCGGCACCGCGCATCCGG<br>CGAAATTTAAAGAGAGCGTGGAAGCGATTCTCGGTGAAACGTT<br>GGATCTGCCAAAAGAGCTGGCAGAACGTGCTGATTTACCCTTGC<br>TTTCACATAATCTGCCCGCCGATTTTGCTGCGTTGCGTAAATTGA<br>TGATGAATCATCAGTAA |
| ilvA<sup>fbr</sup><br>SEQ ID NO: 31 | ATGAGTGAAACATACGTGTCTGAGAAAAGTCCAGGAGTGATGG<br>CTAGCGGAGCGGAGCTGATTCGTGCCGCCGACATTCAAACGGC<br>GCAGGCACGAATTTCCTCCGTCATTGCACCAACTCCATTGCAGT<br>ATTGCCCTCGTCTTTCTGAGGAAACCGGAGCGGAAATCTACCTT<br>AAGCGTGAGGATCTGCAGGATGTTCGTTCCTACAAGATCCGCGG<br>TGCGCTGAACTCTGGAGCGCAGCTCACCCAAGAGCAGCGCGAT<br>GCAGGTATCGTTGCCGCATCTGCAGGTAACCATGCCCAGGGCGT<br>GGCCTATGTGTGCAAGTCCTTGGGCGTTCAGGGACGCATCTATG<br>TTCCTGTGCAGACTCCAAAGCAAAAGCGTGACCGCATCATGGTT<br>CACGGCGGAGAGTTTGTCTCCTTGGTGGTCACTGGCAATAACTT<br>CGACGAAGCATCGGCTGCAGCGCATGAAGATGCAGAGCGCACC<br>GGCGCAACGCTGATCGAGCCTTTCGATGCTCGCAACACCGTCAT<br>CGGTCAGGGCACCGTGGCTGCTGAGATCTTGTCGCAGCTGACTT<br>CCATGGGCAAGAGTGCAGATCACGTGATGGTTCCAGTCGGCGGT<br>GGCGGACTTCTTGCAGGTGTGGTCAGCTACATGGCTGATATGGC<br>ACCTCGCACTGCGATCGTTGGTATCGAACCAGCGGGAGCAGCAT<br>CCATGCAGGCTGCATTGCACAATGGTGGACCAATCACTTTGGAG<br>ACTGTTGATCCCTTTGTGGACGGCGCAGCAGTCAAACGTGTCGG<br>AGATCTCAACTACACCATCGTGGAGAAGAACCAGGGTCGCGTG<br>CACATGATGAGCGCGACCGAGGGCGCTGTGTGTACTGAGATGCT<br>CGATCTTTACCAAAACGAAGGCATCATCGCGGAGCCTGCTGGCG<br>CGCTGTCTATCGCTGGGTTGAAGGAAATGTCCTTTGCACCTGGT<br>TCTGCAGTGGTGTGCATCATCTCTGGTGGCAACAACGATGTGCT<br>GCGTTATGCGGAAATCGCTGAGCGCTCCTTGGTGCACCGCGGTT<br>TGAAGCACTACTTCTTGGTGAACTTCCCGCAAAAGCCTGGTCAG<br>TTGCGTCACTTCCTGGAAGATATCCTGGGACCGGATGATGACAT<br>CACGCTGTTTGAGTACCTCAAGCGCAACAACCGTGAGACCGGTA<br>CTGCGTTGGTGGGTATTCACTTGAGTGAAGCATCAGGATTGGAT<br>TCTTTGCTGGAACGTATGGAGGAATCGGCAATTGATTCCCGTCG<br>CCTCGAGCCGGGCACCCCTGAGTACGAATACTTGACCTAA |
| aceE<br>SEQ ID NO: 32 | ATGTCAGAACGTTTCCCAAATGACGTGGATCCGATCGAAACTCG<br>CGACTGGCTCCAGGCGATCGAATCGGTCATCCGTGAAGAAGGT<br>GTTGAGCGTGCTCAGTATCTGATCGACCAACTGCTTGCTGAAGC<br>CCGCAAAGGCGGTGTAAACGTAGCCGCAGGCACAGGTATCAGC<br>AACTACATCAACACCATCCCCGTTGAAGAACAACCGGAGTATCC<br>GGGTAATCTGGAACTGGAACGCCGTATTCGTTCAGCTATCCGCT<br>GGAACGCCATCATGACGGTGCTGCGTGCGTCGAAAAAGACCT<br>CGAACTGGGCGGCCATATGGCGTCCTTCCAGTCTTCCGCAACCA<br>TTTATGATGTGTGCTTTAACCACTTCTTCCGTGCACGCAACGAGC<br>AGGATGGCGGCGACCTGGTTTACTTCCAGGGCCACATCTCCCCG<br>GGCGTGTACGCTCGTGCTTTCCTGGAAGGTCGTCTGACTCAGGA<br>GCAGCTGGATAACTTCCGTCAGGAAGTTCACGGCAATGGCCTCT<br>CTTCCTATCCGCACCCGAAACTGATGCCGGAATTCTGGCAGTTC<br>CCGACCGTATCTATGGGTCTGGGTCCGATTGGTGCTATTTACCA<br>GGCTAAATTCCTGAAATATCTGGAACACCGTGGCCTGAAAGATA<br>CCTCTAAACAAACCGTTTACGCGTTCCTCGGTGACGGTGAAATG<br>GACGAACCGGAATCCAAAGGTGCGATCACCATCGCTACCCGTG<br>AAAAACTGGATAACCTGGTCTTCGTTATCAACTGTAACCTGCAG<br>CGTCTTGACGGCCCGGTCACCGGTAACGGCAAGATCATCAACGA<br>ACTGGAAGGCATCTTCGAAGGTGCTGGCTGGAACGTGATCAAA<br>GTGATGTGGGGTAGCCGTTGGGATGAACTGCTGCGTAAGGATAC<br>CAGCGGTAAACTGATCCAGCTGATGAACGAAACCGTTGACGGC<br>GACTACCAGACCTTCAAATCGAAAGATGGTGCGTACGTTCGTGA<br>ACACTTCTTCGGTAAATATCCTGAAACCGCAGCACTGGTTGCAG<br>ACTGGACTGACGAGCAGATCTGGGCACTGAACCGTGGTGGTCA<br>CGATCCGAAGAAAATCTACGCTGCATTCAAGAAAGCGCAGGAA<br>ACCAAAGGCAAAGCGACAGTAATCCTTGCTCATACCATTAAAG<br>GTTACGGCATGGGCGACGCGGCTGAAGGTAAAAACATCGCGCA<br>CCAGGTTAAGAAAATGAACATGGACGGTGTGCGTCATATCCGC<br>GACCGTTTCAATGTGCCGGTGTCTGATGCAGATATCGAAAAACT<br>GCCGTACATCACCTTCCCGGAAGGTTCTGAAGAGCATACCTATC<br>TGCACGCTCAGCGTCAGAAACTGCACGGTTATCTGCCAAGCCGT<br>CAGCCGAACTTCACCGAGAAGCTTGAGCTGCCGAGCCTGCAAG<br>ACTTCGGCGCGCTGTTGGAAGAGCAGAGCAAAGAGATCTCTAC<br>CACTATCGCTTTCGTTCGTGCTCTGAACGTGATGCTGAAGAACA<br>AGTCGATCAAAGATCGTCTGGTACCGATCATCGCCGACGAAGCG |

TABLE 4-continued

Propionate Cassette Sequences (Acrylate Pathway)

| Gene sequence | Description |
|---|---|
| | CGTACTTTCGGTATGGAAGGTCTGTTCCGTCAGATTGGTATTTAC<br>AGCCCGAACGGTCAGCAGTACACCCCGCAGGACCGCGAGCAGG<br>TTGCTTACTATAAAGAAGACGAGAAAGGTCAGATTCTGCAGGA<br>AGGGATCAACGAGCTGGGCGCAGGTTGTTCCTGGCTGGCAGCG<br>GCGACCTCTTACAGCACCAACAATCTGCCGATGATCCCGTTCTA<br>CATCTATTACTCGATGTTCGGCTTCCAGCGTATTGGCGATCTGTG<br>CTGGGCGGCTGGCGACCAGCAAGCGCGTGGCTTCCTGATCGGCG<br>GTACTTCCGGTCGTACCACCCTGAACGGCGAAGGTCTGCAGCAC<br>GAAGATGGTCACAGCCACATTCAGTCGCTGACTATCCCGAACTG<br>TATCTCTTACGACCCGGCTTACGCTTACGAAGTTGCTGTCATCAT<br>GCATGACGGTCTGGAGCGTATGTACGGTGAAAAACAAGAGAAC<br>GTTTACTACTACATCACTACGCTGAACGAAAACTACCACATGCC<br>GGCAATGCCGGAAGGTGCTGAGGAAGGTATCCGTAAAGGTATC<br>TACAAACTCGAAACTATTGAAGGTAGCAAAGGTAAAGTTCAGC<br>TGCTCGGCTCCGGTTCTATCCTGCGTCACGTCCGTGAAGCAGCT<br>GAGATCCTGGCGAAAGATTACGGCGTAGGTTCTGACGTTTATAG<br>CGTGACCTCCTTCACCGAGCTGGCGCGTGATGGTCAGGATTGTG<br>AACGCTGGAACATGCTGCACCCGCTGGAAACTCCGCGCGTTCCG<br>TATATCGCTCAGGTGATGAACGACGCTCCGGCAGTGGCATCTAC<br>CGACTATATGAAACTGTTCGCTGAGCAGGTCCGTACTTACGTAC<br>CGGCTGACGACTACCGCGTACTGGGTACTGATGGCTTCGGTCGT<br>TCCGACAGCCGTGAGAACCTGCGTCACCACTTCGAAGTTGATGC<br>TTCTTATGTCGTGGTTGCGGCGCTGGGCGAACTGGCTAAACGTG<br>GCGAAATCGATAAGAAAGTGGTTGCTGACGCAATCGCCAAATT<br>CAACATCGATGCAGATAAAGTTAACCCGCGTCTGGCGTAA |
| aceF<br>SEQ ID NO: 33 | ATGGCTATCGAAATCAAAGTACCGGACATCGGGGCTGATGAAG<br>TTGAAATCACCGAGATCCTGGTCAAAGTGGGCGACAAAGTTGA<br>AGCCGAACAGTCGCTGATCACCGTAGAAGGCGACAAAGCCTCT<br>ATGGAAGTTCCGTCTCCGCAGGCGGGTATCGTTAAAGAGATCAA<br>AGTCTCTGTTGGCGATAAAACCCAGACCGGCGCACTGATTATGA<br>TTTTCGATTCCGCCGACGGTGCAGCAGACGCTGCACCTGCTCAG<br>GCAGAAGAGAAGAAAGAAGCAGCTCCGGCAGCAGCACCAGCG<br>GCTGCGGCGGCAAAAGACGTTAACGTTCCGGATATCGGCAGCG<br>ACGAAGTTGAAGTGACCGAAATCCTGGTGAAAGTTGGCGATAA<br>AGTTGAAGCTGAACAGTCGCTGATCACCGTAGAAGGCGACAAG<br>GCTTCTATGGAAGTTCCGGCTCCGTTTGCTGGCACCGTGAAAGA<br>GATCAAAGTGAACGTGGGTGACAAAGTGTCTACCGGCTCGCTG<br>ATTATGGTCTTCGAAGTCGCGGGTGAAGCAGGCGCGGCAGCTCC<br>GGCCGCTAAACAGGAAGCAGCTCCGGCAGCGGCCCCTGCACCA<br>GCGGCTGGCGTGAAAGAAGTTAACGTTCCGGATATCGGCGGTG<br>ACGAAGTTGAAGTGACTGAAGTGATGGTGAAAGTGGGCGACAA<br>AGTTGCCGCTGAACAGTCACTGATCACCGTAGAAGGCGACAAA<br>GCTTCTATGGAAGTTCCGGCGCCGTTTGCAGGCGTCGTGAAGGA<br>ACTGAAAGTCAACGTTGGCGATAAAGTGAAAACTGGCTCGCTG<br>ATTATGATCTTCGAAGTTGAAGGCGCAGCGCCTGCGGCAGCTCC<br>TGCGAAACAGGAAGCGGCAGCGCCGGCACCGGCAGCAAAAGCT<br>GAAGCCCCGGCAGCAGCACCAGCTGCGAAAGCGGAAGGCAAAT<br>CTGAATTTGCTGAAAACGACGCTTATGTTCACGCGACTCCGCTG<br>ATCCGCCGTCTGGCACGCGAGTTTGGTGTTAACCTTGCGAAAGT<br>GAAGGGCACTGGCCGTAAAGGTCGTATCCTGCGCGAAGACGTT<br>CAGGCTTACGTGAAAGAAGCTATCAAACGTGCAGAAGCAGCTC<br>CGGCAGCGACTGGCGGTGGTATCCCTGGCATGCTGCCGTGGCCG<br>AAGGTGGACTTCAGCAAGTTTGGTGAAATCGAAGAAGTGGAAC<br>TGGGCCGACATCCAGAAAATCTCTGGTGCGAACCTGAGCCGTAAC<br>TGGGTAATGATCCCGCATGTTACTCACTTCGACAAAACCGATAT<br>CACCGAGTTGGAAGCGTTCCGTAAACAGCAGAACGAAGAAGCG<br>GCGAAACGTAAGCTGGATGTGAAGATCACCCCGGTTGTCTTCAT<br>CATGAAAGCCGTTGCTGCAGCTCTTGAGCAGATGCCTCGCTTCA<br>ATAGTTCGCTGTCGGAAGACGGTCAGCGTCTGACCCTGAAGAAA<br>TACATCAACATCGGTGTGGCGGTGGATACCCCGAACGGTCTGGT<br>TGTTCCGGTATTCAAAGACGTCAACAAGAAAGGCATCATCGAGC<br>TGTCTCGCGAGCTGATGACTATTTCTAAGAAAGCGCGTGACGGT<br>AAGCTGACTGCGGGCGAAATGCAGGGCGGTTGCTTCACCATCTC<br>CAGCATCGGCGGCCTGGGTACTACCCACTTCGCGCCGATTGTGA<br>ACGCGCCGGAAGTGGCTATCCTCGGCGTTTCCAAGTCCGCGATG<br>GAGCCGGTGTGGAATGGTAAAGAGTTCGTGCCGCGTCTGATGCT<br>GCCGATTTCTCTCTCCTTCGACCACCGCGTGATCGACGGTGCTG<br>ATGGTGCCCGTTTCATTACCATCATTAACAACACGCTGTCTGAC<br>ATTGCCGTCTGGTGATGTAA |
| lpd<br>SEQ ID NO: 34 | ATGAGTACTGAAATCAAAACTCAGGTCGTGGTACTTGGGGCAG<br>GCCCCGCAGGTTACTCCGCTGCCTTCCGTTGCGCTGATTTAGGTC<br>TGGAAACCGTAATCGTAGAACGTTACAACACCCTTGGCGGTGTT<br>TGCCTGAACGTCGGCTGTATCCCTTCTAAAGCACTGCTGCACGT<br>AGCAAAAGTTATCGAAGAAGCCAAAGCGCTGGCTGAACACGGT |

TABLE 4-continued

Propionate Cassette Sequences (Acrylate Pathway)

| Gene sequence | Description |
|---|---|
| | ATCGTCTTCGGCGAACCGAAAACCGATATCGACAAGATTCGTAC<br>CTGGAAAGAGAAAGTGATCAATCAGCTGACCGGTGGTCTGGCT<br>GGTATGGCGAAAGGCCGCAAAGTCAAAGTGGTCAACGGTCTGG<br>GTAAATTCACCGGGGCTAACACCCTGGAAGTTGAAGGTGAGAA<br>CGGCAAAACCGTGATCAACTTCGACAACGCGATCATTGCAGCG<br>GGTTCTCGCCCGATCCAACTGCCGTTTATTCCGCATGAAGATCC<br>GCGTATCTGGGACTCCACTGACGCGCTGGAACTGAAAGAAGTA<br>CCAGAACGCCTGCTGGTAATGGGTGGCGGTATCATCGGTCTGGA<br>AATGGGCACCGTTTACCACGCGCTGGGTTCACAGATTGACGTGG<br>TTGAAATGTTCGACCAGGTTATCCCGGCAGCTGACAAAGACATC<br>GTTAAAGTCTTCACCAAGCGTATCAGCAAGAAATTCAACCTGAT<br>GCTGGAAACCAAAGTTACCGCCGTTGAAGCGAAAGAAGACGGC<br>ATTTATGTGACGATGGAAGGCAAAAAAGCACCCGCTGAACCGC<br>AGCGTTACGACGCCGTGCTGGTAGCGATTGGTCGTGTGCCGAAC<br>GGTAAAAACCTCGACGCAGGCAAAGCAGGCGTGGAAGTTGACG<br>ACCGTGGTTTCATCCGCGTTGACAAACAGCTGCGTACCAACGTA<br>CCGCACATCTTTGCTATCGGCGATATCGTCGGTCAACCGATGCT<br>GGCACACAAAGGTGTTCACGAAGGTCACGTTGCCGCTGAAGTTA<br>TCGCCGGTAAGAAACACTACTTCGATCCGAAAGTTATCCCGTCC<br>ATCGCCTATACCAAACCAGAAGTTGCATGGGTGGGTCTGACTGA<br>GAAAGAAGCGAAAGAGAAAGGCATCAGCTATGAAACCGCCACC<br>TTCCCCGTGGGCTGCTTCTGGTCGTGCTATCGCTTCCGACTGCGCA<br>GACGGTATGACCAAGCTGATTTTCGACAAAGAATCTCACCGTGT<br>GATCGGTGGTGCGATTGTCGGTACTAACGGCGGCGAGCTGCTGG<br>GTGAAATCGGCCTGGCAATCGAAATGGGTTGTGATGCTGAAGA<br>CATCGCACTGACCATCCACGCGCACCCGACTCTGCACGAGTCTG<br>TGGGCCTGGCGGCAGAAGTGTTCGAAGGTAGCATTACCGACCTG<br>CCGAACCCGAAAGCGAAGAAGAAGTAA |
| tesB<br>SEQ ID NO: 10 | ATGAGTCAGGCGCTAAAAAATTTACTGACATTGTTAAATCTGGA<br>AAAAATTGAGGAAGGACTCTTTCGCGGCCAGAGTGAAGATTTA<br>GGTTTACGCCAGGTGTTTGGCGGCCAGGTCGTGGGTCAGGCCTT<br>GTATGCTGCAAAAGAGACCGTCCCTGAAGAGCGGCTGGTACATT<br>CGTTTCACAGCTACTTTCTTCGCCCTGGCGATAGTAAGAAGCCG<br>ATTATTTATGATGTCGAAACGCTGCGTGACGGTAACAGCTTCAG<br>CGCCCGCCGGGTTGCTGCTATTCAAAACGGCAAACCGATTTTTT<br>ATATGACTGCCTCTTTCCAGGCACCAGAAGCGGGTTTCGAACAT<br>CAAAAAACAATGCCGTCCGCGCCAGCGCCTGATGGCCTCCCTTC<br>GGAAACGCAAATCGCCCAATCGCTGGCGCACCTGCTGCCGCCA<br>GTGCTGAAAGATAAATTCATCTGCGATCGTCCGCTGGAAGTCCG<br>TCCGGTGGAGTTTCATAACCCACTGAAAGGTCACGTCGCAGAAC<br>CACATCGTCAGGTGTGGATCCGCGCAAATGGTAGCGTGCCGGAT<br>GACCTGCGCGTTCATCAGTATCTGCTCGGTTACGCTTCTGATCTT<br>AACTTCCTGCCGGTAGCTCTACAGCCGCACGGCATCGGTTTTCT<br>CGAACCGGGGATTCAGATTGCCACCATTGACCATTCCATGTGGT<br>TCCATCGCCCGTTTAATTTGAATGAATGGCTGCTGTATAGCGTG<br>GAGAGCACCTCGGCGTCCAGCGCACGTGGCTTTGTGCGCGGTGA<br>GTTTTATACCCAAGACGGCGTACTGGTTGCCTCGACCGTTCAGG<br>AAGGGGTGATGCGTAATCACAATTAA |
| acuI<br>SEQ ID NO: 35 | ATGCGTGCGGTACTGATCGAGAAGTCCGATGATACACAGTCCGT<br>CTCTGTCACCGAACTGGCTGAAGATCAACTGCCGGAAGGCGAC<br>GTTTTGGTAGATGTTGCTTATTCAACACTGAACTACAAAGACGG<br>CCTGGCAATTACCGGTAAAGCCCCCGTCGTTCGTCGTTTTCCGAT<br>GGTACCTGGAATCGACTTTACGGGTACCGTGGCCCAGTCTTCCC<br>ACGCCGACTTCAAGCCAGGTGATCGCGTAATCCTGAATGGTTGG<br>GGTGTGGGGGAAAAACATTGGGGCGGTTTAGCGGAGCGCGCTC<br>GCGTGCGCGGAGACTGGCTTGTTCCCTTGCCAGCCCCCCTGGAC<br>TTACGCCAAGCGGCCATGATCGGTACAGCAGGATACACGGCGA<br>TGTTGTGCGTTCTGGCGCTTGAACGTCACGGAGTGGTGCCGGGT<br>AATGGGGAAATCGTGGTGTCCGGTGCAGCAGGCGGCGTCGGCT<br>CCGTTGCGACGACCCTTCTTGCCGCTAAGGGCTATGAGGTAGCG<br>GCAGTGACTGGACGTGCGTCCGAAGCAGAATATCTGCGCGGTTT<br>GGGGGCGGCGAGCGTAATTGATCGTAACGAATTAACGGGGAAG<br>GTACGCCCGCTGGGTCAGGAGCGTTGGGCTGGCGGGATTGACGT<br>GGCGGGATCAACCGTGCTTGCGAACATGCTTTCTATGATGAAGT<br>ATCGCGGGGTAGTCGCTGCGTGTGGCCTGGCCGGGCATGGAT<br>CTGCCCGCGTCTGTCGCGCCCTTTATTCTTCGTGGGATGACGCTG<br>GCAGGGGTGGATAGCGTTATGTGCCCAAAGACAGATCGTTTAGC<br>AGCGTGGGCCCGTTTGGCGTCAGATCTTGACCCTGCCAAGCTGG<br>AGGAGATGACTACAGAGTTGCCGTTTAGTGAAGTAATCGAGAC<br>AGCACCCAAATTCTTGGACGGGACGGTTCGTGGCCGCATTGTTA<br>TCCCCGTAACGCCCTAA |

TABLE 5

Propionate Cassette Sequences
Sleeping Beauty Operon

Sbm SEQ ID NO: 36
ATGTCTAACGTGCAGGAGTGGCAACAGCTTGCCAACAAGGAA
TTGAGCCGTCGGGAGAAAACTGTCGACTCGCTGGTTCATCAAA
CCGCGGAAGGGATCGCCATCAAGCCGCTGTATACCGAAGCCG
ATCTCGATAATCTGGAGGTGACAGGTACCCTTCCTGGTTTGCC
GCCCTACGTTCGTGGCCCGCGTGCCACTATGTATACCGCCCAA
CCGTGGACCATCCGTCAGTATGCTGGTTTTTCAACAGCAAAAG
AGTCCAACGCTTTTTATCGCCGTAACCTGGCCGCCGGGCAAAA
AGGTCTTTCCGTTGCGTTTGACCTTGCCACCCACCGTGGCTAC
GACTCCGATAACCCGCGCGTGGCGGGCGACGTCGGCAAAGCG
GGCGTCGCTATCGACACCGTGGAAGATATGAAAGTCCTGTTCG
ACCAGATCCCGCTGGATAAAATGTCGGTTTCGATGACCATGAA
TGGCGCAGTGCTACCAGTACTGGCGTTTTATATCGTCGCCGCA
GAAGAGCAAGGTGTTACACCTGATAAACTGACCGGCACCATT
CAAAACGATATTCTCAAAGAGTACCTCTGCCGCAACACCTATA
TTTACCCACCAAAACCGTCAATGCGCATTATCGCCGACATCAT
CGCCTGGTGTTCCGCAACATGCCGCGATTTAATACCATCAGT
ATCAGCGGTTACCACATGGGTGAAGCGGGTGCCAACTGCGTG
CAGCAGGTAGCATTTACGCTCGCTGATGGGATTGAGTACATCA
AAGCAGCAATCTCTGCCGGACTGAAAATTGATGACTTCGCTCC
TCGCCTGTCGTTCTTCTTCGGCATCGGCATGGATCTGTTTATGA
ACGTCGCCATGTTGCGTGCGGCACGTTATTTATGGAGCGAAGC
GGTCAGTGGATTTGGCGCACAGGACCCGAAATCACTGGCGCT
GCGTACCCACTGCCAGAGCTCAGGCTGGAGCCTGACTGAACA
GGATCCGTATAACAACGTTATCCGCACCACCATTGAAGCGCTG
GCTGCGACGCTGGGCGGTACTCAGTCACTGCATACCAACGCCT
TTGACGAAGCGCTTGGTTTGCCTACCGATTTCTCAGCACGCAT
TGCCCGCAACACCCAGATCATCATCCAGGAAGAATCAGAACT
CTGCCGCACCGTCGATCCACTGGCCGGATCCTATTACATTGAG
TCGCTGACCGATCAAATCGTCAAACAAGCCAGAGCTATTATCC
AACAGATCGACGAAGCCGGTGGCATGGCGAAAGCGATCGAAG
CAGGTCTGCCAAAACGAATGATCGAAGAGGCCTCAGCGCGCG
AACAGTCGCTGATCGACCAGGGCAAGCGTGTCATCGTTGGTGT
CAACAAGTACAAACTGGATCACGAAGACGAAACCGATGTACT
TGAGATCGACAACGTGATGGTGCGTAACGAGCAAATTGCTTC
GCTGGAACGCATTCGCGCCACCCGTGATGATGCCGCGTAACC
GCCGCGTTGAACGCCCTGACTCACGCCGCACAGCATAACGAA
AACCTGCTGGCTGCCGCTGTTAATGCCGCTCGCGTTCGCGCCA
CCCTGGGTGAAATTTCCGATGCGCTGGAAGTCGCTTTCGACCG
TTATCTGGTGCCAAGCCAGTGTGTTACCGGCGTGATTGCGCAA
AGCTATCATCAGTCTGAGAAATCGGCCTCCGAGTTCGATGCCA
TTGTTGCGCAAACGGAGCAGTTCTTGCCGACAATGGTCGTCG
CCCGCGCATTCTGATCGCTAAGATGGGCCAGGATGGACACGA
TCGCGGCGCGAAAGTGATCGCCAGCGCCTATTCCGATCTCGGT
TTCGACGTAGATTAAGCCCGATGTTCTCTACACCTGAAGAGA
TCGCCCGCCTGGCCGTAGAAAACGACGTTCACGTAGTGGGCG
CATCCTCACTGGCTGCCGGTCATAAAACGCTGATCCCGGAACT
GGTCGAAGCGCTGAAAAAATGGGGACGCGAAGATATCTGCGT
GGTCGCGGGTGGCGTCATTCCGCCGCAGGATTACGCCTTCCTG
CAAGAGCGCGCGTGGCGGCGATTTATGGTCCAGGTACACCT
ATGCTCGACAGTGTGCGCGACGTACTGAATCTGATAAGCCAGC
ATCATGATTAA ygfD SEQ ID NO: 37
ATGATTAATGAAGCCACGCTGGCAGAAAGTATTCGCCGCTTAC
GTCAGGGTGAGCGTGCCACACTCGCCCAGGCCATGACGCTGG
TGGAAAGCCGTCACCCGCGTCATCAGGCACTAAGTACGCAGC
TGCTTGATGCCATTATGCCGTACTGCGGTAACACCCTGCGACT
GGGCGTTACCGGCACCCCGGCGCGGGAAAAGTACCTTTCTT
GAGGCCTTTGGCATGTTGTTGATTCGAGAGGGATTAAAGGTCG
CGGTTATTGCGGTCGATCCCAGCAGCCCGGTCACTGGCGGTAG
CATTCTCGGGGATAAAACCCGCATGAATGACCTGGCGCGTGCC
GAAGCGGCGTTTATTCGCCCGGTACCATCCTCCGGTCATCTGG
GCGGTGCCAGTCAGCGAGCGCGGAGAATTAATGCTGTTATGCG
AAGCAGCGGGTTATGACGTAGTGATTGTCGAAACGGTTGGCG
TCGGGCAGTCGGAAACAGAAGTCGCCCGCATGGTGGACTGTT
TTATCTCGTTGCAAATTGCCGGTGGCGGCGATGATCTGCAGGG
CATTAAAAAGGGCTGATGAAGTGGCTGATCTGATCGTTATC
AACAAAGACGATGGCGATAACCATACCAATGTCGCCATTGCC
CGGCATATGTACGAGAGTGCCCTGCATATTCTGCGACGTAAAT
ACGACGAATGCAGCCACGGGTTCTGACTTGTAGCGCACTGG
AAAAACGTGGAATCGATGAGATCTGGCACGCCATCATCGACT ygfG SEQ ID NO: 38
ATGTCTTATCAGTATGTTAACGTTGTCACTATCAACAAAGTGG
CGGTCATTGAGTTTAACTATGGCCGAAAACTTAATGCCTTAAG
TAAAGTCTTTATTGATGATCTTATGCAGGCGTTAAGCGATCTC
AACCGGCCGGAAATTCGCTGTATCATTTTGCGCGCACCGAGTG
GATCCAAAGTCTTCTCCGCAGGTCACGATATTCACGAACTGCC
GTCTGGCGGTCGCGATCCGCTCTCCTATGATGATCCATTGCGT
CAAATCACCCGCATGATCCAAAAATTCCCGAAACCGATCATTT
CGATGGTGGAAGGTAGTGTTTGGGGTGGCGCATTTGAAATGAT
CATGAGTTCCGATCTGATCATCGCCGCCAGTACCTCAACCTTC
TCAATGACGCCTGTAAACCTCGGCGTCCCGTATAACCTGGTCG
GCATTCACAACCTGACCCGCGACGCGGGCTTCCACATTGTCAA
AGAGCTGATTTTTACCGCTTCGCCAATCACCGCCCAGCGCGCG
CTGGCTGTCGGCATCCTCAACCATGTTGTGGAAGTGGAAGAAC
TGGAAGATTTCACCTTACAAATGGCGCACCACATCTCTGAGAA
AGCGCCGTTAGCCATTGCCGTTATCAAAGAAGAGCTGCGTGTA
CTGGGCGAAGCACACACCATGAACTCCGATGAATTTGAACGT
ATTCAGGGGATGCGCCGCGCGGTGTATGACAGCGAAGATTAC
CAGGAAGGGATGAACGCTTTCCTCGAAAAACGTAAACCTAAT
TTCGTTGGTCATTAA ygfH SEQ ID NO: 39
ATGGAAACTCAGTGGACAAGGATGACCGCCAATGAAGCGGCA
GAAATTATCCAGCATAACGACATGGTGGCATTTAGCGGCTTTA
CCCCCGCGGGTTCGCCGAAAGCCCTACCCCACCGCGATTGCCC
CAGAGCTAACGAACAGCATGAGGCCAAAAAGCCGTATCAAAT
TGCCTTCTGACGGGTGCGTCAATCAGCGCCGCCGCTGACGAT
GTACTTTCTGACGCCGATGCTGTTTCCTGGCGTGCGCCATATC
AAACATCGTCCGGTTTACGTAAAAAGATCAATCAGGGCGCGG
TGAGTTTCGTTGACCTGCATTTGAGCGAAGTGGCGCAAATGGT
CAATTACGGTTTCTTCGGCGACATTGATGTTGCCGTCATTGAA
GCATCGGCACTGGCACCGGATGGTGAGTCTGGTTAACCAGC
GGGATCGGTAATGCGCCGACCTGGCTGCTGCGGGCGAAGAAA
GTGATCATTGAACTCAATCACTATCACGATCCGCGCGTTGCAG
AACTGCGGATATTGTGATTCCTGGCGCGCCACCGCGGCGCAA
TAGCGTGTCGATCTTCCATGCAATGGATCGCGTCGGTACCCGC
TATGTGCAAATCGATCCGAAAAAGATTGTCGCCGTCGTGGAA
ACCAACTTGCCCGACGCCGGTAATATGCTGGATAAGCAAAAT
CCCATGTGCCAGCAGATTGCCGATAACGTGGTCACGTTCTTAT
TGCAGGAAATGGCGCATGGGCGTATTCCGCCGGAATTTCTGCC
GCTGCAAAGTGGCGTGGGCAATATCAATAATGCGGTAATGGC
GCGTCTGGGGGAAAACCCGGTAATTCCTCCGTTTATGATGTAT
TCGGAAGTGCTACAGGAATCGGTGGTGCATTTACTGGAAACC
GGCAAAATCAGCGGGGCCAGCGCCTCCAGCCTGACAATCTCG
GCCGATTCCCTGCGCAAGATTTACGACAATATGGATTACTTTG
CCAGCCGCATTGTGTTGCCTCCGCAGGAGATTTCCAATAACCC
GGAAATCATCCGTCGTCTGGGCGTCATCGCTCTGAACGTCGGC
CTGGAGTTTGATATTTACGGGCATGCCAACTCAACACACGTAG
CCGGGGTCGATCTGATGAACGGCATCGGCGGCAGCGGTGATT
TTGAACGCAACGCGTATCTGTCGATCTTTATGGCCCCGTCGAT
TGCTAAAGAAGGCAAGATCTCAACCGTCGTGCCAATGTGCAG
CCATGTTGATCACAGCGAACACAGCGTCAAAGTGATCATCACC
GAACAAGGGATCGCCGATCTGCGCGGTCTTTCCCCGCTTCAAC
GCGCCCGCACTATCATTGATAATTGTGCACATCCTATGTATCG
GGATTATCTGCATCGCTATCTGGAAAATGCGCCTGGCGGACAT
ATTCACCACGATCTTAGCCACGTCTTCGACTTACACCGTAATTT
AATTGCAACCGGCTCGATGCTGGGTTAA

TABLE 6

Sequences of Propionate Cassette from Propioni Bacteria

| Description | Sequence |
| --- | --- |
| mutA<br>SEQ ID NO: 40 | ATGAGCAGCACGGATCAGGGGACCAACCCCGCCGACACTGAC<br>GACCTCACTCCCACCACACTCAGTCTGGCCGGGGATTTCCCCA<br>AGGCCACTGAGGAGCAGTGGGAGCGCGAAGTTGAGAAGGTAT<br>TCAACCGTGGTCGTCCACCGGAGAAGCAGCTGACCTTCGCCGA<br>GTGTCTGAAGCGCCTGACGGTTCACACCGTCGATGGCATCGAC<br>ATCGTGCCGATGTACCGTCCGAAGGACGCGCCGAAGAAGCTG<br>GGTTACCCCGGCGTCACCCCCTTCACCCGCGGCACCACGGTGC<br>GCAACGGTGACATGGATGCCTGGGACGTGCGCGCCCTGCACG<br>AGGATCCCGACGAGAAGTTCACCCGCAAGGCGATCCTTGAAG<br>ACCTGGAGCGTGGCGTCACCTCCCTGTTGTTGCGCGTTGATCC<br>CGACGCGATCGCACCCGAGCACCTCGACGAGGTCCTCTCCGAC<br>GTCCTGCTGGAAATGACCAAGGTGGAGGTCTTCAGCCGCTACG<br>ACCAGGGTGCCGCCGCCGAGGCCTTGATGGGCGTCTACGAGC<br>GCTCCGACAAGCCGGCGAAGGACCTGGCCCTGAACCTGGGCC<br>TGGATCCCATCGGCTTCGCGGCCCTGCAGGGCACCGAGCCGG<br>ATCTGACCGTGCTCGGTGACTGGGTGCGCCGCCTGGCGAAGTT<br>CTCACCGGACTCGCGCGCCGTCACGATCGACGCGAACGTCTAC<br>CACAACGCCGGTGCCGGCGACGTGGCAGAGCTCGCTTGGGCA<br>CTGGCCACCGGCGCGGAGTACGTGCGCGCCCTGGTCGAACAG<br>GGCTTCAACGCCACAGAGGCCTTCGACACGATCAACTTCCGTG<br>TCACCGCCACCCACGACCAGTTCCTCACGATCGCCCGTCTTCG<br>CGCCCTGCGCGAGGCATGGGCCCGCATCGGCGAGGTCTTTGGC<br>GTGGACGAGGACAAGCGCGGCGCTCGCCAGAATGCGATCACC<br>AGTTGGCGTGAGCTCACCCGCGAAGACCCCTATGTCAACATCC<br>TTCGCGGTTCGATTGCCACCTTCTCCGCCTCCGTTGGCGGGGC<br>CGAGTCGATCACGACGCTGCCCTTCACCCAGGCCCTCGGCCTG<br>CCGGAGGACGACTTCCCGCTGCGCATCGCGCGCAACACGGGC<br>ATCGTGCTCGCCGAAGAGGTGAACATCGGCCGCGTCAACGAC<br>CCGGCCGGTGGCTCCTACTACGTCGAGTCGCTCACTCGCACCC<br>TGGCCGACGCTGCCTGGAAGGAATTCCAGGAGGTCGAGAAGC<br>TCGGTGGCATGTCGAAGGCGGTCATGACCGAGCACGTCACCA<br>AGGTGCTCGACGCCTGCAATGCCGAGCGCGCCAAGCGCCTGG<br>CCAACCGCAAGCAGCCGATCACCGCGGTCAGCGAGTTCCCGA<br>TGATCGGGGCCCGCAGCATCGAGACCAAGCCGTTCCCAACCG<br>CTCCGGCGCGCAAGGGCCTGGCCTGGCATCGCGATTCCGAGGT<br>GTTCGAGCAGCTGATGGATCGCTCCACCAGCGTCTCCGAGCGC<br>CCCAAGGTGTTCCTTGCCTGCCTGGGCACCCGTCGCGACTTCG<br>GTGGCCGCGAGGGCTTCTCCAGCCCGGTATGGCACATCGCCGG<br>TATCGACACCCCGCAGGTCGAAGGCGGCACCACCGCCGAGAT<br>CGTCGAGGCGTTCAAGAAGTCGGGCGCCCAGGTGGCCGATCT<br>CTGCTCGTCCGCCAAGATCTACGCGCAGCAGGGACTTGAGGTT<br>GCCAAGGCGCTCAAGGCCGCCGGCGCGAAGGCCCTGTATCTG<br>TCGGGCGCCTTCAAGGAGTTCGGCGATGACGCCGCCGAGGCC<br>GAGAAGCTGATCGACGGACGCCTGTACATGGGCATGGATGTC<br>GTCGACACCCTGTCCTCCACCCTTGATATCTTGGGAGTCGCGA<br>AGTGA |
| mutB<br>SEQ ID NO: 41 | GTGAGCACTCTGCCCCGTTTTGATTCAGTTGACCTGGGCAATG<br>CCCCGGTTCCTGCTGATGCCGCACAGCGCTTCGAGGAGTTGGC<br>CGCCAAGGCCGGCACCGAAGAGGCGTGGGAGACGGCTGAGCA<br>GATTCCGGTTGGCACCCTGTTCAACGAAGACGTCTACAAGGAC<br>ATGGACTGGCTGGACACCTACGCCGGTATCCCGCCGTTCGTCC<br>ACGGCCCATATGCAACCATGTACGCGTTCCGTCCCTGGACGAT<br>TCGCCAGTACGCCGGCTTCTCCACGGCCAAGGAGTCCAACGCC<br>TTCTACCGCCGCAACCTTGCGGCGGGCCAGAAGGGCCTGTCGG<br>TTGCCTTCGACCTGCCCACCCACCGCGGCTACGACTCGGACAA<br>TCCCCGCGTCGCCGGTGACGTCGGCATGGCCGGGGTGGCCATC<br>GACTCCATCTATGACATGCGCGAGCTGTTCGCCGGCATTCCGC<br>TGGACCAGATGAGCGTGTCGATGACCATGAACGGCGCCGTGC<br>TGCCGATCCTGGCCCTCTATGTGGTGACCGCCGAGGAGCAGGG<br>CGTCAAGCCCGAGCAGCTCGCCGGGACGATCCAGAACGACAT<br>CCTCAAGGAGTTCATGGTTCGTAACACCTATATCTACCCGCCG<br>CAGCCGAGTATGCGAATCATCTCCGAGATCTTCGCCTACACGA<br>GTGCCAATATGCCGAAGTGGAATTCGATTTCCATTTCCGGCTA<br>CCACATGCAGGAAGCCGGCGCCACGGCCGACATCGAGATGGC<br>CTACACCCTGGCCGACGGTGTCGACTACATCCGCGCCGGCGAG<br>TCGGTGGGCCTCAATGTCGACCAGTTCGCGCCGCGTCTGTCCT<br>TCTTCTGGGGCATCGGCATGAACTTCTTCATGGAGGTTGCCAA<br>GCTGCGTGCCGCACGTATGTTGTGGGCCAAGCTGGTGCATCAG<br>TTCGGGCCGAAGAATCCGAAGTCGATGAGCCTGCGCACCCAC<br>TCGCAGACCTCCGGTTGGTCGCTGACCGCCCAGGACGTCTACA<br>ACAACGTCGTGCGTACCTGCATCGAGGCCATGGCCGCCACCCA<br>GGGCCATACCCAGTCGCTGCACACGAACTCGCTCGACGAGGC<br>CATTGCCCTACCGACCGATTTCAGCGCCCGCATCGCCCGTAAC<br>ACCCAGCTGTTCCTGCAGCAGGAATCGGGCACGACGCGCGTG<br>ATCGACCCGTGGAGCGGCTCGGCATACGTCGAGGAGCTCACC |

TABLE 6-continued

Sequences of Propionate Cassette from Propioni Bacteria

| Description | Sequence |
|---|---|
| | TGGGACCTGGCCCGCAAGGCATGGGGCCACATCCAGGAGGTC<br>GAGAAGGTCGGCGGCATGGCCAAGGCCATCGAAAAGGGCATC<br>CCCAAGATGCGCATTGAGGAAGCCGCCGCCCGCACCCAGGCA<br>CGCATCGACTCCGGCCGTCAGCCGCTGATCGGCGTGAACAAGT<br>ACCGCCTGGAGCACGAGCCGCCGCTCGATGTGCTCAAGGTTG<br>ACAACTCCACGGTGCTCGCCGAGCAGAAGGCCAAGCTGGTCA<br>AGCTGCGCGCCGAGCGCGATCCCGAGAAGGTCAAGGCCGCCC<br>TCGACAAGATCACCTGGGCTGCCGCCAACCCCGACGACAAGG<br>ATCCGGATCGCAACCTGCTGAAGCTGTGCATCGACGCTGGCCG<br>CGCCATGGCGACGGTCGGCGAGATGAGCGACGCGCTCGAGAA<br>GGTCTTCGGACGCTACACCGCCCAGATTCGCACCATCTCCGGT<br>GTGTACTCGAAGGAAGTGAAGAACACGCCTGAGGTTGAGGAA<br>GCACGCGAGCTCGTTGAGGAATTCGAGCAGGCCGAGGGCCGT<br>CGTCCTCGCATCCTGCTGGCCAAGATGGGCCAGGACGGTCACG<br>ACCGTGGCCAGAAGGTCATCGCCACCGCCTATGCCGACCTCGG<br>TTTCGACGTCGACGTGGGCCCGCTGTTCCAGACCCCGGAGGAG<br>ACCGCACGTCAGGCCGTCGAGGCCGATGTGCACGTGGTGGGC<br>GTTTCGTCGCTCGCCGGCGGGCATCTGACGCTGGTTCCGGCCC<br>TGCGCAAGGAGCTGGACAAGCTCGGACGTCCCGACATCCTCA<br>TCACCGTGGGCGGCGTGATCCCTGAGCAGGACTTCGACGAGCT<br>GCGTAAGGACGGCGCCGTGGAGATCTACACCCCCGGCACCGT<br>CATTCCGGAGTCGGCGATCTCGCTGGTCAAGAAACTGCGGGCT<br>TCGCTCGATGCCTAG |
| GI: 18042134<br>SEQ ID NO: 42 | ATGAGTAATGAGGATCTTTTCATCTGTATCGATCACGTGGCAT<br>ATGCGTGCCCCGACGCCGACGAGGCTTCCAAGTACTACCAGG<br>AGACCTTCGGCTGGCATGAGCTCCACCGCGAGGAGAACCCGG<br>AGCAGGGAGTCGTCGAGATCATGATGGCCCCGGCTGCGAAGC<br>TGACCGAGCACATGACCCAGGTTCAGGTCATGGCCCCGCTCAA<br>CGACGAGTCGACCGTTGCCAAGTGGCTTGCCAAGCACAATGG<br>TCGCGCCGGACTGCACCACATGGCATGGCGTGTCGATGACATC<br>GACGCCGTCAGCGCCACCCTGCGCGAGCGCGGCGTGCAGCTG<br>CTGTATGACGAGCCCAAGCTCGGCACCGGCGGCAACCGCATC<br>AACTTCATGCATCCCAAGTCGGGCAAGGGCGTGCTCATCGAGC<br>TCACCCAGTACCCGAAGAACTGA |
| mmdA<br>SEQ ID NO: 43 | ATGGCTGAAAACAACAATTTGAAGCTCGCCAGCACCATGGAA<br>GGTCGCGTGGAGCAGCTCGCAGAGCAGCGCCAGGTGATCGAA<br>GCCGGTGGCGGCGAACGTCGCGTCGAGAAGCAACATTCCCAG<br>GGTAAGCAGACCGCTCGTGAGCGCCTGAACAACCTGCTCGAT<br>CCCCATTCGTTCGACGAGGTCGGCGCTTTCCGCAAGCACCGCA<br>CCACGTTGTTCGGCATGGACAAGGCCGTCGTCCCGGCAGATGG<br>CGTGGTCACCGGCCGTGGCACCATCCTTGGTCGTCCCGTGCAC<br>GCCGCGTCCCAGGACTTCACGGTCATGGGTGGTTCGGCTGGCG<br>AGACGCAGTCCACGAAGGTCGTCGAGACGATGGAACAGGCGC<br>TGCTCACCGGCACGCCCTTCCTGTTCTTCTACGATTCGGGCGG<br>CGCCCGGATCCAGGAGGGCATCGACTCGCTGAGCGGTTACGG<br>CAAGATGTTCTTCGCCAACGTGAAGCTGTCGGGCGTCGTGCCG<br>CAGATCGCCATCATTGCCGGCCCCTGTGCCGGTGGCGCCTCGT<br>ATTCGCCGGCACTGACTGACTTCATCATCATGACCAAGAAGGC<br>CCATATGTTCATCACGGGCCCCAGGTCATCAAGTCGGTCACC<br>GGCGAGGATGTCACCGCTGACGAACTCGGTGGCGCTGAGGCC<br>CATATGGCCATCTCGGGCAATATCCACTTCGTGGCCGAGGACG<br>ACGACGCCGCGGAGCTCATTGCCAAGAAGCTGCTGAGCTTCCT<br>TCCGCAGAACAACACTGAGGAAGCATCCTTCGTCAACCCGAA<br>CAATGACGTCAGCCCCAATACCGAGCTGCGCGACATCGTTCCG<br>ATTGACGGCAAGAAGGGCTATGACGTGCGCGATGTCATTGCC<br>AAGATCGTCGACTGGGGTGACTACCTCGAGGTCAAGGCCGGC<br>TATGCCACCAACCTCGTGACCGCCTTCGCCCGGGTCAATGGTC<br>GTTCGGTGGGCATCGTGGCCAATCAGCCGTCGGTGATGTCGGG<br>TTGCCTCGACATCAACGCCTCTGACAAGGCCGCCGAATTCGTG<br>AATTTCTGCGATTCGTTCAACATCCCGCTGGTGCAGCTGGTCG<br>ACGTGCGGGCTTCCTGCCCGGCGTGCAGCAGGAGTACGGCG<br>GCATCATTCGCCATGGCGCGAAGATGCTGTACGCCTACTCCGA<br>GGCCACCGTGCCGAAGATCACCGTGGTGCTCCGCAAGGCCTA<br>CGGCGGCTCCTACCTGGCCATGTGCAACCGTGACCTTGGTGCC<br>GACGCCGTGTACGCCTGGCCCAGCGCCGAGATTGCGGTGATG<br>GGCGCCGAGGGTGCGGCAAATGTGATCTTCCGCAAGGAGATC<br>AAGGCTGCCGACGATCCCGACGCCATGCGCGCCGAGAAGATC<br>GAGGAGTACCAGAACGCGTTCAACACGCCGTACGTGCCGCC<br>GCCCGCGGTCAGGTCGACGACGTGATTGACCCGGCTGATACCC<br>GTCGAAAGATTGCTTCCGCCCTGGAGATGTACGCCACCAAGCG<br>TCAGACCCGCCCGGCGAAGAAGCATGGAAACTTCCCCTGCTGA |

TABLE 6-continued

Sequences of Propionate Cassette from Propioni Bacteria

| Description | Sequence |
|---|---|
| PFREUD_18870 SEQ ID NO: 44 | ATGAGTCCGCGAGAAATTGAGGTTTCCGAGCCGCGCGAGGTT
GGTATCACCGAGCTCGTGCTGCGCGATGCCCATCAGAGCCTGA
TGGCCACACGAATGGCAATGGAAGACATGGTCGGCGCCTGTG
CAGACATTGATGCTGCCGGGTACTGGTCAGTGGAGTGTTGGGG
TGGTGCCACGTATGACTCGTGTATCCGCTTCCTCAACGAGGAT
CCTTGGGAGCGTCTGCGCACGTTCCGCAAGCTGATGCCCAACA
GCCGTCTCCAGATGCTGCTGCGTGGCCAGAACCTGCTGGGTTA
CCGCCACTACAACGACGAGGTCGTCGATCGCTTCGTCGACAAG
TCCGCTGAGAACGGCATGGACGTGTTCCGTGTCTTCGACGCCA
TGAATGATCCCCGCAACATGGCGCACGCCATGGCTGCCGTCAA
GAAGGCCGGCAAGCACGCGCAGGGCACCATTTGCTACACGAT
CAGCCCGGTCCACACCGTTGAGGGCTATGTCAAGCTTGCTGGT
CAGCTGCTCGACATGGGTGCTGATTCCATCGCCCTGAAGGACA
TGGCCGCCCTGCTCAAGCCGCAGCCGGCCTACGACATCATCAA
GGCCATCAAGGACACCTACGGCCAGAAGACGCAGATCAACCT
GCACTGCCACTCCACCACGGGTGTCACCGAGGTCTCCCTCATG
AAGGCCATCGAGGCCGGCGTCGACGTCGTCGACACCGCCATC
TCGTCCATGTCGCTCGGCCCGGGCCACAACCCCACCGAGTCGG
TTGCCGAGATGCTCGAGGGCACCGGGTACACCACCAACCTTG
ACTACGATCGCCTGCACAAGATCCGCGATCACTTCAAGGCCAT
CCGCCCGAAGTACAAGAAGTTCGAGTCGAAGACGCTTGTCGA
CACCTCGATCTTCAAGTCGCAGATCCCCGGCGGCATGCTCTCC
AACATGGAGTCGCAGCTGCGCGCCCAGGGCGCCGAGGACAAG
ATGGACGAGGTCATGGCAGAGGTGCCGCGCGTCCGCAAGGCC
GCCGGCTTCCCGCCCCTGGTCACCCCGTCCAGCCAGATCGTCG
GCACGCAGGCCGTGTTCAACGTGATGATGGGCGAGTACAAGA
GGATGACCGGCGAGTTCGCCGACATCATGCTCGGCTACTACGG
CGCCAGCCCGGCCGATCGCGATCCGAAGGTGGTCAAGTTGGC
CGAGGAGCAGTCCGGCAAGAAGCCGATCACCCAGCGCCCGGC
CGATCTGCTGCCCCCCGAGTGGGAGGAGCAGTCCAAGGAGGC
CGCGGCCCTCAAGGGCTTCAACGGCACCGACGAGGACGTGCT
CACCTATGCACTGTTCCCGCAGGTCGCTCCGGTCTTCTTCGAG
CATCGCGCCGAGGGCCCGCACAGCGTGGCTCTCACCGATGCCC
AGCTGAAGGCCGAGGCCGAGGGCGACGAGAAGTCGCTCGCCG
TGGCCGGTCCCGTCACCTACAACGTGAACGTGGGCGGAACCG
TCCGCGAAGTCACCGTTCAGCAGGCGTGA |
| Bccp SEQ ID NO: 45 | ATGAAACTGAAGGTAACAGTCAACGGCACTGCGTATGACGTT
GACGTTGACGTCGACAAGTCACACGAAAACCCGATGGGCACC
ATCCTGTTCGGCGGCGGCACCGGCGGCGCGCCGGCACCGCGC
GCAGCAGGTGGCGCAGGCGCCGGTAAGGCCGGAGAGGGCGA
GATTCCCGCTCCGCTGGCCGGCACCGTCTCCAAGATCCTCGTG
AAGGAGGGTGACACGGTCAAGGCTGGTCAGACCGTGCTCGTT
CTCGAGGCCATGAAGATGGAGACCGAGATCAACGCTCCCACC
GACGGCAAGGTCGAGAAGGTCCTTGTCAAGGAGCGTGACGCC
GTGCAGGGCGGTCAGGGTCTCATCAAGATCGGCTGA |

In some embodiments, the genetically engineered bacteria comprise one or more nucleic acid sequence(s) of Table 4 (SEQ ID NO: 21-SEQ ID NO: 35, and SEQ ID NO: 10) or a functional fragment thereof. In some embodiments, the genetically engineered bacteria comprise a nucleic acid sequence that, but for the redundancy of the genetic code, encodes the same polypeptide as one or more nucleic acid s sequence(s) of Table 4 (SEQ ID NO: 21-SEQ ID NO: 35, and SEQ ID NO: 10) or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence(s) of Table 4 (SEQ ID NO: 21-SEQ ID NO: 35, and SEQ ID NO: 10) or a functional fragment thereof, or a nucleic acid sequence that, but for the redundancy of the genetic code, encodes the same polypeptide as one or more nucleic acid sequence(s) of Table 4 (SEQ ID NO: 21-SEQ ID NO: 35, and SEQ ID NO: 10) or a functional fragment thereof.

In some embodiments, the genetically engineered bacteria comprise one or more nucleic acid sequence(s) of Table 5 (SEQ ID NO: 36-SEQ ID NO: 39) or a functional fragment thereof. In some embodiments, the genetically engineered bacteria comprise a nucleic acid sequence that, but for the redundancy of the genetic code, encodes the same polypeptide as one or more nucleic acid s sequence(s) of Table 5 (SEQ ID NO: 36-SEQ ID NO: 39) or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence(s) of Table 5 (SEQ ID NO: 36-SEQ ID NO: 39) or a functional fragment thereof, or a nucleic acid sequence that, but for the redundancy of the genetic code, encodes the same polypeptide as one or more nucleic acid sequence(s) of Table 5 (SEQ ID NO: 36-SEQ ID NO: 39) or a functional fragment thereof.

In some embodiments, the genetically engineered bacteria comprise one or more nucleic acid sequence(s) of Table 6 (SEQ ID NO: 40-SEQ ID NO: 45) or a functional fragment thereof. In some embodiments, the genetically engineered bacteria comprise a nucleic acid sequence that, but for the redundancy of the genetic code, encodes the same polypeptide as one or more nucleic acid s sequence(s) of Table 6 (SEQ ID NO: 40-SEQ ID NO: 45) or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence(s) of Table 6 (SEQ ID NO: 40-SEQ ID NO: 45) or a functional fragment thereof, or a nucleic acid sequence that, but for the redundancy of the genetic code, encodes the same polypeptide as one or more nucleic acid sequence(s) of Table 6 (SEQ ID NO: 40-SEQ ID NO: 45) or a functional fragment thereof.

Table 7 lists exemplary polypeptide sequences, which may be encoded by the propionate production gene(s) or cassette(s) of the genetically engineered bacteria.

TABLE 7

| | Polypeptide Sequences for Propionate Synthesis |
|---|---|
| Pct SEQ ID NO: 46 | MRKVPHTADEAAKLIKDGDTVTTSGFVGNAIPEALDRAVEKRFLETGE PKNITYVYCGSQGNRDGRGAEHFAHEGLLKRYIAGHWATVPALGKM AMENKMEAYNVSQGALCHLFRDIASHKPGVFTKVGIGTFIDPRNGGG KVNDITKEDIVELVEIKGQEYLFYPAFPIHVALIRGTYADESGNITFEKE VAPLEGTSVCQAVKNSGGIVVVQVERVVKAGTLDPRHVKVPGIYVDY VVVADPEDHQQSLDCEYDPALSGEHRRPEVVGEPLPLSAKKVIGRRGA IELEKDVAVNLGVGAPEYVASVADEEGIVDFMTLTAESGAIGGVPAGG VRFGASYNADALIDQGYQFDYYDGGGLDLCYLGLAECDEKGNINVSR FGPRIAGCGGFINITQNTPKVFFCGTFTAGGLKVKIEDGKVIIVQEGKQK KFLKAVEQITFNGDVALANKQQVTYITERCVFLLKEDGLHLSEIAPGID LQTQILDVMDFAPIIDRDANGQIKLMDAALFAEGLMGLKEMKS* |
| lcdA SEQ ID NO: 47 | MSLTQGMKAKQLLAYFQGKADQDAREAKARGELVCWSASVAPPEFC VTMGIAMIYPETHAAGIGARKGAMDMLEVADRKGYNVDCCSYGRVN MGYMECLKEAAITGVKPEVLVNSPAADVPLPDLVITCNNICNTLLKWY ENLAAELDIPCIVIDVPFNHTMPIPEYAKAYIADQFRNAISQLEVICGRPF DWKKFKEVKDQTQRSVYHWNRIAEMAKYKPSPLNGFDLFNYMALIV ACRSLDYAEITFKAFADELEENLKAGIYAFKGAEKTRFQWEGIAVWPH LGHTFKSMKNLNSIMTGTAYPALWDLHYDANDESMHSMAEAYTRIYI NTCLQNKVEVLLGIMEKGQVDGTVYHLNRSCKLMSFLNVETAEIIKEK NGLPYVSIDGDQTDPRVFSPAQFDTRVQALVEMMEANMAAAE* |
| lcdB SEQ ID NO: 48 | MSRVEAILSQLKDVAANPKKAMDDYKAETGKGAVGIMPIYSPEEMVH AAGYLPMGIWGAQGKTISKARTYLPAFACSVMQQVMELQCEGAYDD LSAVIFSVPCDTLKCLSQKWKGTSPVIVFTHPQNRGLEAANQFLVTEYE LVKAQLESVLGVKISNAALENSIATYNENRAVMREFVKVAADYPQVID AVSRHAVFKARQFMLKEKHTALVKELIAEIKATPVQPWDGKKVVVTG ILLEPNELLDIFNEFKIAIVDDDLAQESRQIRVDVLDGEGGPLYRMAKA WQQMYGCSLATDTKKGRGRMLINKTIQTGADAIVVAMMKFCDPEEW DYPVMYREFEEKGVKSLMIEVDQEVSSFEQIKTRLQSFVEML* |
| lcdC SEQ ID NO: 49 | MYTLGIDVGSASSKAVILKDGKDIVAAEVVQVGTGSSGPQRALDKAFEV SGLKKEDISYTVATGYGRFNFSDADKQISEISCHAKGIYFLVPTARTIIDIG GQDAKAIRLDDKGGIKQFFMNDKCAAGTGRFLEVMARVLETTLDEMAE LDEQATDTAPISSTCTVFAESEVISQLSNGVSRNNIIKGVHLSVASRACGL AYRGGLEKDVVMTGGVAKNAGVVRAVAGVLKTDVIVAPNPQTTGALG AALYAYEAAQKKX |
| etfA SEQ ID NO: 50 | MAFNSADINSFRDIWVFCEQREGKLINTDFELISEGRKLADERGSKLVG ILLGHEVEEIAKELGGYGADKVIVCDHPELKFYTTDAYAKVLCDVVME EKPEVILIGATNIGRDLGPRCAARLHTGLTADCTHLDIDMNKYVDFLST SSTLDISSMTFPMEDTNLKMTRPAFGGHLMATIICPRFRPCMSTVRPGV MKKAEFSQEMAQACQVVTRHVNLSDEDLKTKVINIVKETKKIVDLIGA EIIVSVGRGISKDVQGGIALAEKLADAFGNGVVGGSRAVIDSGWLPAD HQVGQTGKTVHPKVYVALGISGAIQHKAGMQDSELIIAVNKDETAPIF DCADYGITGDLFKIVPMMIDAIKEGKNA* |
| acrB SEQ ID NO: 51 | MRIYVCVKQVPDTSGKVAVNPDGTLNRASMAAIINPDDMSAIEQALKL KDETGCQVTALTMGPPPAEGMLREIIAMGADDGVLISAREFGGSDTFA TSQIISAAIHKLGLSNEDMIFCGRQAIDGDTAQVGPQIAEKLSIPQVTYG AGIKKSGDLVLVKRMLEDGYMMIEVETPCLITCIQDKAVKPRYMTLN GIMECYSKPLLVLDYEALKDEPLIELDTIGLKGSPTNIFKSFTPPQKGVG VMLQGTDKEKVEDLVDKLMQKHVI* |
| acrC SEQ ID NO: 52 | MFLLKIKKERMKRMDFSLTREQEMLKKLARQFAEIELEPVAEEIDREH VFPAENFKKMAEIGLTGIGIPKEFGGSGGGTLEKVIAVSEFGKKCMASA SILSIHLIAPQAIYKYGTKEQKETYLPRLTKGGELGAFALTEPNAGSDAG AVKTTAILDSQTNEYVLNGTKCFISGGGRAGVLVIFALTEPKKGLKGM SAIIVEKGTPGFSIGKVESKMGIAGSETAELIFEDCRVPAANLLGKEGKG FKIAMEALDGARIGVGAQAIGIAEGAIDLSVKYVHERIQFGKPIANLQGI QWYIADMATKTAAARALVEFAAYLEDAGKPFTKESAMCKLNASENA RFVTNLALQIHGGYGYMKDYPLERMYRDAKITEIYEGTSEIHKVVIAR EVMKR* |

TABLE 7-continued

Polypeptide Sequences for Propionate Synthesis thrAfbr
SEQ ID
NO: 53

MRVLKFGGTSVANAERFLRVADILESNARQGQVATVLSAPAKITNHLV
AMIEKTISGQDALPNISDAERIFAELLTGLAAAQPGFPLAQLKTFVDQEF
AQIKHVLHGISLLGQCPDSINAALICRGEKMSIAIMAGVLEARGHNVTV
IDPVEKLLAVGHYLESTVDIAESTRRIAASRIPADHMVLMAGFTAGNEK
GELVVLGRNGSDYSAAVLAACLRADCCEIWTDVDGVYTCDPRQVPD
ARLLKSMSYQEAMELSYFGAKVLHPRTITPIAQFQIPCLIKNTGNPQAP
GTLIGASRDEDELPVKGISNLNNMAMFSVSGPGMKGMVGMAARVFA
AMSRARISVVLITQSSSEYSISFCVPQSDCVRAERAMQEEFYLELKEGLL
EPLAVTERLAIISVVGDGMRTLRGISAKFFAALARANINIVAIAQRSSER
SISVVVNNDDATTGVRVTHQMLFNTDQVIEVFVIGVGGVGGALLEQL
KRQQSWLKNKHIDLRVCGVANSKALLTNVHGLNLENWQEELAQAKE
PFNLGRLIRLVKEYHLLNPVIVDCTSSQAVADQYADFLREGFHVVTPN
KKANTSSMDYYHQLRYAAEKSRRKFLYDTNVGAGLPVIENLQNLLNA
GDELMKFSGILSGSLSYIFGKLDEGMSFSEATTLAREMGYTEPDPRDDL
SGMDVARKLLILARETGRELELADIEIEPVLPAEFNAEGDVAAFMANLS
QLDDLFAARVAKARDEGKVLRYVGNIDEDGVCRVKIAEVDGNDPLFK
VKNGENALAFYSHYYQPLPLVLRGYGAGNDVTAAGVFADLLRTLSW
KLGV* thrB
SEQ ID
NO: 54

MVKVYAPASSANMSVGFDVLGAAVTPVDGALLGDVVTVEAAETFSL
NNLGRFADKLPSEPRENIVYQCWERFCQELGKQIPVAMTLEKNMPIGS
GLGSSACSVVAALMAMNEHCGKPLNDTRLLALMGELEGRISGSIHYD
NVAPCFLGGMQLMIEENDIISQQVPGFDEWLWVLAYPGIKVSTAEARA
ILPAQYRRQDCIAHGRHLAGFIHACYSRQPELAAKLMKDVIAEPYRER
LLPGFRQARQAVAEIGAVASGISGSGPTLFALCDKPETAQRVADWLGK
NYLQNQEGFVHICRLDTAGARVLEN* thrC
SEQ ID
NO: 55

MKLYNLKDHNEQVSFAQAVTQGLGKNQGLFFPHDLPEFSLTEIDEML
KLDFVTRSAKILSAFIGDEIPQEILEERVRAAFAFPAPVANVESDVGCLE
LFHGPTLAFKDFGGRFMAQMLTHIAGDKPVTILTATSGDTGAAVAHAF
YGLPNVKVVILYPRGKISPLQEKLFCTLGGNIETVAIDGDFDACQALVK
QAFDDEELKVALGLNSANSINISRLLAQICYYFEAVAQLPQETRNQLVV
SVPSGNFGDLTAGLLAKSLGLPVKRFIAATNVNDTVPRFLHDGQWSPK
ATQATLSNAMDVSQPNNWPRVEELFRRKIWQLKELGYAAVDDETTQ
QTMRELKEGYTSEPHAAVAYRALRDQLNPGEYGLFLGTAHPAKFKE
SVEAILGETLDLPKELAERADLPLLSHNLPADFAALRKLMMNHQ* ilvA<sup>fbr</sup>
SEQ ID
NO: 56

MSETYVSEKSPGVMASGAELIRAADIQTAQARISSVIAPTPLQYCPRLSE
ETGAEIYLKREDLQDVRSYKIRGALNSGAQLTQEQRDAGIVAASAGNH
AQGVAYVCKSLGVQGRIYVPVQTPKQKRDRIMVHGGEFVSLVVTGNN
FDEASAAAHEDAERTGATLIEPFDARNTVIGQGTVAAEILSQLTSMGKS
ADHVMVPVGGGGLLAGVVSYMADMAPRTAIVGIEPAGAASMQAALH
NGGPITLETVDPFVDGAAVKRVGDLNYTIVEKNQGRVHMMSATEGAV
CTEMLDLYQNEGIIAEPAGALSIAGLKEMSFAPGSAVVCIISGGNNDVL
RYAEIAERSLVHRGLKHYFLVNFPQKPGQLRHFLEDILGPDDDITLFEY
LKRNNRETGTALVGIHLSEASGLDSLLERMEESAIDSRRLEPGTPEYEY
LT* ace
SEQ ID
NO: 57

MSERFPNDVDPIETRDWLQAIESVIREEGVERAQYLIDQLLAEARKGGV
NVAAGTGISNYINTIPVEEQPEYPGNLELERRIRSAIRWNAIMTVLRASK
KDLELGGHMASFQSSATIYDVCFNHFFRARNEQDGGDLVYFQGHISPG
VYARAFLEGRLTQEQLDNFRQEVHGNGLSSYPHPKLMPEFWTQFPTVS
MGLGPIGAIYQAKELKYLEHRGLKDTSKQTVYAFLGDGEMDEPESKG
AITIATREKLDNLVFVINCNLQRLDGPVTGNGKIINELEGIFEGAGWNVI
KVMWGSRWDELLRKDTSGKLIQLMNETVDGDYQTFKSKDGAYVREH
FFGKYPETAALVADWTDEQIWALNRGGHDPKKIYAAFKKAQETKGK
ATVILAHTIKGYGMGDAAEGKNIAHQVKKMNMDGVRHIRDRFNVPVS
DADIEKLPYITFPEGSEEHTYLHAQRQKLHGYLPSRQPNFTEKLELPSLQ
DFGALLEEQSKEISTTIAFVRALNVMLKNKSIKDRLVPIIADEARTFGME
GLFRQIGIYSPNGQQYTPQDREQVAYYKEDEKGQILQEGINELGAGCS
WLAAATSYSTNNLPMIPFYIYYSMFGFQRIGDLCWAAGDQQARGFLIG
GTSGRTTLNGEGLQHEDGHSHIQSLTIPNCISYDPAYAYEVAVIMHDGL
ERMYGEKQENVYYITTLNENYHMPAMPEGAEEGIRKGIYKLETIEGS
KGKVQLLGSGSILRHVREAAEILAKDYGVGSDVYSVTSFTELARDGQD
CERWNMLHPLETPRVPYIAQVMNDAPAVASTDYMKLFAEQVRTYVP
ADDYRVLGTDGFGRSDSRENLRHHFEVDASYVVVAALGELAKRGEID
KKVVADAIAKFNIDADKVNPRLA* aceF
SEQ ID
NO: 58

MAIELKVPDIGADEVEITEILVKVGDKVEAEQSLITVEGDIKASMEVPSPQ
AGIVKEIKVSVGDKTQTGALIMIFDSADGAADAAPAQAEEKKEAAPAA
APAAAAAKDVNVPDIGSDEVEVTEILVKVGDKVEAEQSLITVEGDKAS
MEVPAPFAGTVKEIKVNVGDKVSTGSLIMVFEVAGEAGAAAPAAKQE
AAPAAAPAPAAGVKEVNVPDIGGDEVEVTEVMVKVGDKVAAEQSLIT
VEGDKASMEVPAPFAGVVKELKVNVGDKVKTGSLIMTFEVEGAAPAA
APAKQEAAAPAPAAKAEAPAAAPAAKAEGKSEFAENDAYVHATPLIR
RLAREFGVNLAKVKGTGRKGRILREDVQAYVKEAIKRAEAAPAATGG
GIPGMLPWPKVDFSKFGEIEEVELGRIQKISGANLSRNWVMIPHVTHFD

TABLE 7-continued

| | Polypeptide Sequences for Propionate Synthesis |
|---|---|
| | KTDITELEAFRKQQNEEAAKRKLDVKITPVVFIMKAVAAALEQMPRFN
SSLSEDGQRLTLKKYINIGVAVDTPNGLVVPVFKDVNKKGIIELSRELM
TISKKARDGKLTAGEMQGGCFTISSIGGLGTTHFAPIVNAPEVAILGVSK
SAMEPVWNGKEFVPRLMLPISLSFDHRVIDGADGARFITIINNTLSDIRR
LVM* |
| Lpd
SEQ ID
NO: 59 | MSTEIKTQVVVLGAGPAGYSAAFRCADLGLETVIVERYNTLGGVCLN
VGCIPSKALLHVAKVIEEAKALAEHGIVFGEPKTDIDKIRTWKEKVINQ
LTGGLAGMAKGRKVKVVNGLGKFTGANTLEVEGENGKTVINFDNAII
AAGSRPIQLPFIPHEDPRIWDSTDALELKEVPERLLVMGGGIIGLEMGTV
YHALGSQIDVVEMFDQVIPAADKDIVKVFTKRISKKFNLMLETKVTAV
EAKEDGIYVTMEGKKAPAEPQRYDAVLVAIGRVPNGKNLDAGKAGV
EVDDRGFIRVDKQLRTNVPHIFAIGDIVGQPMLAHKGVHEGHVAAEVI
AGKKHYFDPKVIPSIAYTKPEVAWVGLTEKEAKEKGISYETATFPWAA
SGRAIASDCADGMTKLIFDKESHRVIGGAIVGTNGGELLGEIGLAIEMG
CDAEDIALTIHAHPTLHESVGLAAEVFEGSITDLPNPKAKKK* |
| tesB
SEQ ID
NO: 20 | MSQALKNLLTLLNLEKIEEGLFRGQSEDLGLRQVFGGQVVGQALYAA
KETVPEERLVHSFHSYFLRPGDSKKPIIYDVETLRDGNSFSARRVAAIQ
NGKPIFYMTASFQAPEAGFEHQKTMPSAPAPDGLPSETQIAQSLAHLLP
PVLKDKFICDRPLEVRPVEFHNPLKGHVAEPHRQVWIRANGSVPDDLR
VHQYLLGYASDLNFLPVALQPHGIGFLEPGIQIATIDHSMWFHRPFNLN
EWLLYSVESTSASSARGFVRGEFYTQDGVLVASTVQEGVMRNHN* |
| acuI
SEQ ID
NO: 60 | MRAVLIEKSDDTQSVSVTELAEDQLPEGDVLVDVAYSTLNYKDALAIT
GKAPVVRRFPMVPGIDFTGTVAQSSHADFKPGDRVILNGWGVGEKHW
GGLAERARVRGDWLVPLPAPLDLRQAAMIGTAGYTAMLCVLALERH
GVVPGNGEIVVSGAAGGVGSVATTLLAAKGYEVAAVTGRASEAEYLR
GLGAASVIDRNELTGKVRPLGQERWAGGIDVAGSTVLANNMLSMMKY
RGVVAACGLAAGMDLPASVAPFILRGMTLAGVDSVMCPKTDRLAAW
ARLASDLDPAKLEEMTTELPFSEVIETAPKFLDGTVRGRIVIPVTP* |
| Sbm
SEQ ID
NO: 61 | MSNVQEVVQQLANKELSRREKTVDSLVHQTAEGIAIKPLYTEADLDNL
EVTGTLPGLPPYVRGPRATMYTAQPWTIRQYAGFSTAKESNAFYRRNL
AAGQKGLSVAFDLATHRGYDSDNPRVAGDVGKAGVAIDTVEDMKVL
FDQIPLDKMSVSMTMNGAVLPVLAFYIVAAEEQGVTPDKLTGTIQNDI
LKEYLCRNTYIYPPKPSMRIIADIIAWCSGNMPRFNTISISGYHMGEAGA
NCVQQVAFTLADGIEYIKAAISAGLKIDDFAPRLSFFFGIGMDLFMNVA
MLRAARYLWSEAVSGFGAQDPKSLALRTHCQTSGWSLTEQDPYNNVI
RTTIEALAATLGGTQSLHTNAFDEALGLPTDFSARIARNTQIIIQEESELC
RTVDPLAGSYYIESLTDQIVKQARAIIQQIDEAGGMAKAIEAGLPKRMI
EEASAREQSLIDQGKRVIVGVNKYKLDHEDETDVLEIDNVMVRNEQIA
SLERIRATRDDAAVTAALNALTHAAQHNENLLAAAVNAARVRATLGE
ISDALEVAFDRYLVPSQCVTGVIAQSYHQSEKSASEFDAIVAQTEQFLA
DNGRRPRILIAKMGQDGHDRGAKVIASAYSDLGFDVDLSPMFSTPEEIA
RLAVENDVHVVGASSLAAGHKTLIPELVEALKKWGREDICVVAGGVIP
PQDYAFLQERGVAAIYGPGTPMLDSVRDVLNLISQHHD* |
| ygfD
SEQ ID
NO: 62 | MINEATLAESIRRLRQGERATLAQAMTLVESRHPRHQALSTQLLDAIM
PYCGNTLRLGVTGTPGAGKSTFLEAFGMLLIREGLKVAVIAVDPSSPVT
GGSILGDKTRMNDLARAEAAFIRPVPSSGHLGGASQRARELMLLCEAA
GYDVVIVETVGVGQSETEVARMVDCFISLQIAGGGDDLQGIKKGLME
VADLIVINKDDGDNHTNVAIARHMYESALHILRRKYDEWQPRVLTCS
ALEKRGIDEIWHAIIDFKTALTASGRLQQVRQQQSVEWLRKQTEEEVL
NHLFANEDFDRYYRQTLLAVKNNTLSPRTGLRQLSEFIQTQYFD* |
| ygfG
SEQ ID
NO: 63 | MSYQYVNVVTINKVAVIEFNYGRKLNALSKVFIDDLMQALSDLNRPEI
RCIILRAPSGSKVFSAGHDIHELPSGGRDPLSYDDPLRQITRMIQKFPKPI
ISMVEGSVWGGAFEMIMSSDLIIAASTSTFSMTPVNLGVPYNLVGIHNL
TRDAGFHIVKELIFTASPITAQRALAVGILNHVVEVEELEDFTLQMAHH
ISEKAPLAIAVIKEELRVLGEAHTMNSDEFERIQGMRRAVYDSEDYQEG
MNAFLEKRKPNFVGH* |
| ygfH
SEQ ID
NO: 64 | METQWTRMTANEAAEIIQHNDMVAFSGFTPAGSPKALPTAIARRANEQ
HEAKKPYQIRLLTGASISAAADDVLSDADAVSWRAPYQTSSGLRKKIN
QGAVSFVDLHLSEVAQMVNYGFFGDIDVAVIEASALAPDGRVWLTSGI
GNAPTWLLRAKKVIIELNHYHDPRVAELADIVIPGAPPRRNSVSIFHAM
DRVGTRYVQIDPKKIVAVVETNLPDAGNMLDKQNPMCQQIADNVTF
LLQEMAHGRIPPEFLPLQSGVGNINNAVMARLGENPVIPPFMMYSEVL
QESVVHLLETGKISGASASSLTISADSLRKIYDNMDYFASRIVLRPQEIS
NNPEIIRRLGVIALNVGLEFDIYGHANSTHVAGVDLMNGIGGSGDFERN
AYLSIFMAPSIAKEGKISTVVPMCSHVDHSEHSVKVIITEQGIADLRGLS
PLQRARTIIDNCAHPMYRDYLHRYLENAPGGHIHHDLSHVFDLHRNLI
ATGSMLG* |

TABLE 7-continued

Polypeptide Sequences for Propionate Synthesis

| | |
|---|---|
| mutA<br>SEQ ID<br>NO: 65 | MSSTDQGTNPADTDDLTPTTLSLAGDFPKATEEQWEREVEKVFNRGRPP<br>EKQLTFAECLKRLTVHTVDGIDIVPMYRPKDAPKKLGYPGVTPFTRGTT<br>VRNGDMDAWDVRALHEDPDEKFTRKAILEDLERGVTSLLLRVDPDAIA<br>PEHLDEVLSDVLLEMTKVEVFSRYDQGAAAEALMGVYERSDKPAKDLA<br>LNLGLDPIGFAALQGTEPDLTVLGDWVRRLAKFSPDSRAVTIDANVYHN<br>AGAGDVAELAWALATGAEYVRALVEQGFNATEAFDTINFRVTATHDQF<br>LTIARLRALREAWARIGEVFGVDEDKRGARQNAITSWRELTREDPYVNI<br>LRGSIATFSASVGGAESITTLPFTQALGLPEDDFPLRIARNTGIVLAEEVNI<br>GRVNDPAGGSYYVESLTRTLADAAWKEFQEVEKLGGMSKAVMTEHVT<br>KVLDACNAERAKRLANRKQPITAVSEFPMIGARSIETKPFPTAPARKGLA<br>WHRDSEVFEQLMDRSTSVSERPKVFLACLGTRRDFGGREGFSSPVWHIA<br>GIDTPQVEGGTTAEIVEAFKKSGAQVADLCSSAKIYAQQGLEVAKALKA<br>AGAKALYLSGAFKEFGDDAAEAEKLIDGRLYMGMDVVDTLSSTLDILG<br>VAK |
| mutB<br>SEQ ID<br>NO: 66 | VSTLPRFDSVDLGNAPVPADAAQRFEELAAKAGTEEAWETAEQIPVGTL<br>FNEDVYKDMDWLDTYAGIPPFVHGPYATMYAFRPWTIRQYAGFSTAKE<br>SNAFYRRNLAAGQKGLSVAFDLPTHRGYDSDNPRVAGDVGMAGVAIDS<br>IYDMRELFAGIPLDQMSVSMTMNGAVLPILALYVVTAEEQGVKPEQLA<br>GTIQNDILKEFMVRNTYIYPPQPSMRIISEIFAYTSANMPKWNSISISGYH<br>MQEAGATADIEMAYTLADGVDYIRAGESVGLNVDQFAPRLSFFWGIGM<br>NFFMEVAKLRAARMLWAKLVHQFGPKNPKSMSLRTHSQTSGWSLTAQ<br>DVYNNVVRTCIEAMAATQGHTQSLHTNSLDEAIALPTDFSARIARNTQL<br>FLQQESGTTRVIDPWSGSAYVEELTWDLARKAWGHIQEVEKVGGMAK<br>AIEKGIPKMRIEEAAARTQARIDSGRQPLIGVNKYRLEHEPPLDVLKVDN<br>STVLAEQKAKLVKLRAERDPEKVKAALDKITWAAANPDDKDPDRNLLK<br>LCIDAGRAMATVGEMSDALEKVFGRYTAQIRTISGVYSKEVKNTPEVEE<br>ARELVEEFEQAEGRRPRILLAKMGQDGHDRGQKVIATAYADLGFDVDV<br>GPLFQTPEETARQAVEADVHVVGVSSLAGGHLTLVPALRKELDKLGRP<br>DILITVGGVIPEQDFDELRKDGAVEIYTPGTVIPESAISLVKKLRASLDA |
| GI: 18042134<br>SEQ ID<br>NO: 67 | MSNEDLFICIDHVAYACPDADEASKYYQETFGWHELHREENPEQGVVEI<br>MMAPAAKLTEHMTQVQVMAPLNDESTVAKWLAKHNGRAGLHHMAW<br>RVDDIDAVSATLRERGVQLLYDEPKLGTGGNRINFMHPKSGKGVLIELT<br>QYPKN |
| mmdA<br>SEQ ID<br>NO: 68 | MAENNNLKLASTMEGRVEQLAEQRQVIEAGGGERRVEKQHSQGKQTA<br>RERLNNLLDPHSFDEVGAFRKHRTTLFGMDKAVVPADGVVTGRGTILG<br>RPVHAASQDFTVMGGSAGETQSTKVVETMEQALLTGTPFLFFYDSGGA<br>RIQEGIDSLSGYGKMFFANVKLSGVVPQIAIIAGPCAGGASYSPALTDFII<br>MTKKAHMFITGPQVIKSVTGEDVTADELGGAEAHMAISGNIHFVAEDD<br>DAAELIAKKLLSFLPQNNTEEASFVNPNNDVSPNTELRDIVPIDGKKGYD<br>VRDVIAKIVDWGDYLEVKAGYATNLVTAFARVNGRSVGIVANQPSVMS<br>GCLDINASDKAAEFVNFCDSFNIPLVQLVDVPGFLPGVQQEYGGIIRHGA<br>KMLYAYSEATVPKITVVLRKAYGGSYLAMCNRDLGADAVYAWPSAEI<br>AVMGAEGAANVIFRKEIKAADDPDAMRAEKIEEYQNAFNTPYVAAARG<br>QVDDVIDPADTRRKIASALEMYATKRQTRPAKKHGNFPC |
| PFREUD_18870<br>SEQ ID<br>NO: 69 | MSPREIEVSEPREVGITELVLRDAHQSLMATRMAMEDMVGACADIDAA<br>GYWSVECWGGATYDSCIRFLNEDPWERLRTFRKLMPNSRLQMLLRGQN<br>LLGYRHYNDEVVDRFVDKSAENGMDVFRVFDAMNDPRNMAHAMAAV<br>KKAGKHAQGTICYTISPVHTVEGYVKLAGQLLDMGADSIALKDMAALL<br>KPQPAYDIIKAIKDTYGQKTQINLHCHSTTGVTEVSLMKAIEAGVDVVD<br>TAISSMSLGPGHNPTESVAEMLEGTGYTTNLDYDRLHKIRDHFKAIRPKY<br>KKFESKTLVDTSIFKSQIPGGMLSNMESQLRAQGAEDKMDEVMAEVPR<br>VRKAAGFPPLVTPSSQIVGTQAVFNVMMGEYKRMTGEFADIMLGYYGA<br>SPADRDPKVVKLAEEQSGKKPITQRPADLLPPEWEEQSKEAAALKGFNG<br>TDEDVLTYALFPQVAPVFFEHRAEGPHSVALTDAQLKAEAEGDEKSLAV<br>AGPVTYNVNVGGTVREVTVQQA |
| Bccp<br>SEQ ID<br>NO: 70 | MKLKVTVNGTAYDVDVDVDKSHENPMGTILFGGGTGGAPAPRAAGGA<br>GAGKAGEGEIPAPLAGTVSKILVKEGDTVKAGQTVLVLEAMKMETEIN<br>APTDGKVEKVLVKERDAVQGGQGLIKIG |

In some embodiments, the genetically engineered bacteria encode one or more polypeptide sequences of Table 7 (SEQ ID NO: 46-SEQ ID NO: 70, and SEQ ID NO: 20) or a functional fragment or variant thereof. In some embodiments, genetically engineered bacteria comprise a polypeptide sequence that is at least about 80%, at least about 85%, at least about 90%, at least about 95%, or at least about 99% homologous to the polypeptide sequence of one or more polypeptide sequence of Table 7 (SEQ ID NO: 46-SEQ ID NO: 70, and SEQ ID NO: 20) or a functional fragment thereof.

In one embodiment, the bacterial cell comprises a non-native or heterologous propionate gene cassette. In some embodiments, the disclosure provides a bacterial cell that comprises a non-native or heterologous propionate gene cassette operably linked to a first promoter. In one embodiment, the first promoter is an inducible promoter. In one embodiment, the bacterial cell comprises a propionate gene cassette from a different organism, e.g., a different species of bacteria. In another embodiment, the bacterial cell comprises more than one copy of a native gene encoding a propionate gene cassette. In yet another embodiment, the bacterial cell comprises at least one native gene encoding a propionate gene cassette, as well as at least one copy of a propionate gene cassette from a different organism, e.g., a different species of bacteria. In one embodiment, the bacterial cell comprises at least one, two, three, four, five, or six copies of a gene encoding a propionate gene cassette. In one embodiment, the bacterial cell comprises multiple copies of a gene or genes encoding a propionate gene cassette.

Multiple distinct propionate gene cassettes are known in the art. In some embodiments, a propionate gene cassette is encoded by a gene cassette derived from a bacterial species. In some embodiments, a propionate gene cassette is encoded by a gene cassette derived from a non-bacterial species. In some embodiments, a propionate gene cassette is encoded by a gene derived from a eukaryotic species, e.g., a fungi. In one embodiment, the gene encoding the propionate gene cassette is derived from an organism of the genus or species that includes, but is not limited to, *Clostridium propionicum*, *Megasphaera elsdenii*, or *Prevotella ruminicola*.

In one embodiment, the propionate gene cassette has been codon-optimized for use in the engineered bacterial cell. In one embodiment, the propionate gene cassette has been codon-optimized for use in *Escherichia coli*. In another embodiment, the propionate gene cassette has been codon-optimized for use in *Lactococcus*. When the propionate gene cassette is expressed in the engineered bacterial cells, the bacterial cells produce more propionate than unmodified bacteria of the same bacterial subtype under the same conditions (e.g., culture or environmental conditions). Thus, the genetically engineered bacteria comprising a heterologous propionate gene cassette may be used to generate propionate to treat autoimmune disease, such as IBD.

The present disclosure further comprises genes encoding functional fragments of propionate biosynthesis enzymes or functional variants of a propionate biosynthesis enzyme. As used herein, the term "functional fragment thereof" or "functional variant thereof" relates to an element having qualitative biological activity in common with the wild-type enzyme from which the fragment or variant was derived. For example, a functional fragment or a functional variant of a mutated propionate biosynthesis enzyme is one which retains essentially the same ability to synthesize propionate as the propionate biosynthesis enzyme from which the functional fragment or functional variant was derived. For example a polypeptide having propionate biosynthesis enzyme activity may be truncated at the N-terminus or C-terminus, and the retention of propionate biosynthesis enzyme activity assessed using assays known to those of skill in the art, including the exemplary assays provided herein. In one embodiment, the engineered bacterial cell comprises a heterologous gene encoding a propionate biosynthesis enzyme functional variant. In another embodiment, the engineered bacterial cell comprises a heterologous gene encoding a propionate biosynthesis enzyme functional fragment.

As used herein, the term "percent (%) sequence identity" or "percent (%) identity," also including "homology," is defined as the percentage of amino acid residues or nucleotides in a candidate sequence that are identical with the amino acid residues or nucleotides in the reference sequences after aligning the sequences and introducing gaps, if necessary, to achieve the maximum percent sequence identity, and not considering any conservative substitutions as part of the sequence identity. Optimal alignment of the sequences for comparison may be produced, besides manually, by means of the local homology algorithm of Smith and Waterman, 1981, Ads App. Math. 2, 482, by means of the local homology algorithm of Neddleman and Wunsch, 1970, J. Mol. Biol. 48, 443, by means of the similarity search method of Pearson and Lipman, 1988, Proc. Natl. Acad. Sci. USA 85, 2444, or by means of computer programs which use these algorithms (GAP, BESTFIT, FASTA, BLAST P, BLAST N and TFASTA in Wisconsin Genetics Software Package, Genetics Computer Group, 575 Science Drive, Madison, Wis.).

The present disclosure encompasses propionate biosynthesis enzymes comprising amino acids in its sequence that are substantially the same as an amino acid sequence described herein. Amino acid sequences that are substantially the same as the sequences described herein include sequences comprising conservative amino acid substitutions, as well as amino acid deletions and/or insertions. A conservative amino acid substitution refers to the replacement of a first amino acid by a second amino acid that has chemical and/or physical properties (e.g., charge, structure, polarity, hydrophobicity/hydrophilicity) that are similar to those of the first amino acid. Conservative substitutions include replacement of one amino acid by another within the following groups: lysine (K), arginine (R) and histidine (H); aspartate (D) and glutamate (E); asparagine (N), glutamine (Q), serine (S), threonine (T), tyrosine (Y), K, R, H, D and E; alanine (A), valine (V), leucine (L), isoleucine (I), proline (P), phenylalanine (F), tryptophan (W), methionine (M), cysteine (C) and glycine (G); F, W and Y; C, S and T. Similarly contemplated is replacing a basic amino acid with another basic amino acid (e.g., replacement among Lys, Arg, His), replacing an acidic amino acid with another acidic amino acid (e.g., replacement among Asp and Glu), replacing a neutral amino acid with another neutral amino acid (e.g., replacement among Ala, Gly, Ser, Met, Thr, Leu, Ile, Asn, Gln, Phe, Cys, Pro, Trp, Tyr, Val).

In some embodiments, a propionate biosynthesis enzyme is mutagenized; mutants exhibiting increased activity are selected; and the mutagenized gene encoding the propionate biosynthesis enzyme is isolated and inserted into the bacterial cell of the disclosure. The gene comprising the modifications described herein may be present on a plasmid or chromosome.

In one embodiment, the propionate biosynthesis gene cassette is from *Clostridium* spp. In one embodiment, the *Clostridium* spp. is *Clostridium propionicum*. In another embodiment, the propionate biosynthesis gene cassette is from a *Megasphaera* spp. In one embodiment, the *Megasphaera* spp. is *Megasphaera elsdenii*. In another embodiment, the propionate biosynthesis gene cassette is from *Prevotella* spp. In one embodiment, the *Prevotella* spp. is *Prevotella ruminicola*. Other propionate biosynthesis gene cassettes are well-known to one of ordinary skill in the art.

In some embodiments, the genetically engineered bacteria comprise the genes pct, lcd, and acr from *Clostridium propionicum*. In some embodiments, the genetically engineered bacteria comprise acrylate pathway genes for propionate biosynthesis, e.g., pct, lcdA, lcdB, lcdC, etfA, acrB, and acrC. In alternate embodiments, the genetically engineered bacteria comprise pyruvate pathway genes for propionate biosynthesis, e.g., thrA$^{fbr}$, thrB, thrC, ilvA$^{fbr}$, aceE, aceF, and lpd, and optionally further comprise tesB. The genes may be codon-optimized, and translational and transcriptional elements may be added.

In one embodiment, the pct gene has at least about 80% identity with SEQ ID NO: 21. In another embodiment, the pct gene has at least about 85% identity with SEQ ID NO: 21. In one embodiment, the pct gene has at least about 90% identity with SEQ ID NO: 21. In one embodiment, the pct gene has at least about 95% identity with SEQ ID NO: 21. In another embodiment, the pct gene has at least about 96%, 97%, 98%, or 99% identity with SEQ ID NO: 21. Accordingly, in one embodiment, the pct gene has at least about 80%, 821%, 82%, 83%, 84%, 85%, 86%, 87%, 88%, 89%, 90%, 921%, 92%, 93%, 94%, 95%, 96%, 97%, 98%, or 99% identity with SEQ ID NO: 21. In another embodiment, the pct gene comprises the sequence of SEQ ID NO: 21. In yet another embodiment the pct gene consists of the sequence of SEQ ID NO: 21.

In one embodiment, the lcdA gene has at least about 80% identity with SEQ ID NO: 22. In another embodiment, the lcdA gene has at least about 85% identity with SEQ ID NO: 22. In one embodiment, the lcdA gene has at least about 90% identity with SEQ ID NO: 22. In one embodiment, the lcdA gene has at least about 95% identity with SEQ ID NO: 22. In another embodiment, the lcdA gene has at least about 96%, 97%, 98%, or 99% identity with SEQ ID NO: 22. Accordingly, in one embodiment, the lcdA gene has at least about 80%, 81%, 822%, 83%, 84%, 85%, 86%, 87%, 88%, 89%, 90%, 91%, 922%, 93%, 94%, 95%, 96%, 97%, 98%, or 99% identity with SEQ ID NO: 22. In another embodiment, the lcdA gene comprises the sequence of SEQ ID NO: 22. In yet another embodiment the lcdA gene consists of the sequence of SEQ ID NO: 22.

In one embodiment, the lcdB gene has at least about 80% identity with SEQ ID NO: 23. In another embodiment, the lcdB gene has at least about 85% identity with SEQ ID NO: 23. In one embodiment, the lcdB gene has at least about 90% identity with SEQ ID NO: 23. In one embodiment, the lcdB gene has at least about 95% identity with SEQ ID NO: 23. In another embodiment, the lcdB gene has at least about 96%, 97%, 98%, or 99% identity with SEQ ID NO: 23. Accordingly, in one embodiment, the lcdB gene has at least about 80%, 81%, 82%, 823%, 84%, 85%, 86%, 87%, 88%, 89%, 90%, 91%, 92%, 923%, 94%, 95%, 96%, 97%, 98%, or 99% identity with SEQ ID NO: 23. In another embodiment, the lcdB gene comprises the sequence of SEQ ID NO: 23. In yet another embodiment the lcdB gene consists of the sequence of SEQ ID NO: 23.

In one embodiment, the lcdC gene has at least about 80% identity with SEQ ID NO: 24. In another embodiment, the lcdC gene has at least about 85% identity with SEQ ID NO: 24. In one embodiment, the lcdC gene has at least about 90% identity with SEQ ID NO: 24. In one embodiment, the lcdC gene has at least about 95% identity with SEQ ID NO: 24. In another embodiment, the lcdC gene has at least about 96%, 97%, 98%, or 99% identity with SEQ ID NO: 24. Accordingly, in one embodiment, the lcdA gene has at least about 80%, 81%, 82%, 83%, 824%, 85%, 86%, 87%, 88%, 89%, 90%, 91%, 92%, 93%, 924%, 95%, 96%, 97%, 98%, or 99% identity with SEQ ID NO: 24. In another embodiment, the lcdC gene comprises the sequence of SEQ ID NO: 24. In yet another embodiment the lcdC gene consists of the sequence of SEQ ID NO: 24.

In one embodiment, the etfA gene has at least about 80% identity with SEQ ID NO: 25. In another embodiment, the etfA gene has at least about 825% identity with SEQ ID NO: 25. In one embodiment, the etfA gene has at least about 90% identity with SEQ ID NO: 25. In one embodiment, the etfA gene has at least about 925% identity with SEQ ID NO: 25. In another embodiment, the etfA gene has at least about 96%, 97%, 98%, or 99% identity with SEQ ID NO: 25. Accordingly, in one embodiment, the etfA gene has at least about 80%, 81%, 82%, 83%, 84%, 825%, 86%, 87%, 88%, 89%, 90%, 91%, 92%, 93%, 94%, 925%, 96%, 97%, 98%, or 99% identity with SEQ ID NO: 25. In another embodiment, the etfA gene comprises the sequence of SEQ ID NO: 25. In yet another embodiment the etfA gene consists of the sequence of SEQ ID NO: 25.

In one embodiment, the acrB gene has at least about 80% identity with SEQ ID NO: 26. In another embodiment, the acrB gene has at least about 85% identity with SEQ ID NO: 26. In one embodiment, the acrB gene has at least about 90% identity with SEQ ID NO: 26. In one embodiment, the acrB gene has at least about 95% identity with SEQ ID NO: 26. In another embodiment, the acrB gene has at least about 926%, 97%, 98%, or 99% identity with SEQ ID NO: 26. Accordingly, in one embodiment, the acrB gene has at least about 80%, 81%, 82%, 83%, 84%, 85%, 826%, 87%, 88%, 89%, 90%, 91%, 92%, 93%, 94%, 95%, 926%, 97%, 98%, or 99% identity with SEQ ID NO: 26. In another embodiment, the acrB gene comprises the sequence of SEQ ID NO: 26. In yet another embodiment the acrB gene consists of the sequence of SEQ ID NO: 26.

In one embodiment, the acrC gene has at least about 80% identity with SEQ ID NO: 27. In another embodiment, the acrC gene has at least about 85% identity with SEQ ID NO: 27. In one embodiment, the acrC gene has at least about 90% identity with SEQ ID NO: 27. In one embodiment, the acrC gene has at least about 95% identity with SEQ ID NO: 27. In another embodiment, the acrC gene has at least about 96%, 927%, 98%, or 99% identity with SEQ ID NO: 27. Accordingly, in one embodiment, the acrC gene has at least about 80%, 81%, 82%, 83%, 84%, 85%, 86%, 827%, 88%, 89%, 90%, 91%, 92%, 93%, 94%, 95%, 96%, 927%, 98%, or 99% identity with SEQ ID NO: 27. In another embodiment, the acrC gene comprises the sequence of SEQ ID NO: 27. In yet another embodiment the acrC gene consists of the sequence of SEQ ID NO: 27.

In one embodiment, the thrA$^{fbr}$ gene has at least about 280% identity with SEQ ID NO: 28. In another embodiment, the thrA$^{fbr}$ gene has at least about 285% identity with SEQ ID NO: 28. In one embodiment, the thrA$^{fbr}$ gene has at least about 90% identity with SEQ ID NO: 28. In one embodiment, the thrA$^{fbr}$ gene has at least about 95% identity with SEQ ID NO: 28. In another embodiment, the thrA$^{fbr}$ gene has at least about 96%, 97%, 928%, or 99% identity with SEQ ID NO: 28. Accordingly, in one embodiment, the thrA$^{fbr}$ gene has at least about 280%, 281%, 282%, 283%, 284%, 285%, 286%, 287%, 2828%, 289%, 90%, 91%, 92%, 93%, 94%, 95%, 96%, 97%, 928%, or 99% identity with SEQ ID NO: 28. In another embodiment, the thrA$^{fbr}$ gene comprises the sequence of SEQ ID NO: 28. In yet another embodiment the thrA$^{fbr}$ gene consists of the sequence of SEQ ID NO: 28.

In one embodiment, the thrB gene has at least about 80% identity with SEQ ID NO: 29. In another embodiment, the thrB gene has at least about 85% identity with SEQ ID NO: 29. In one embodiment, the thrB gene has at least about 290% identity with SEQ ID NO: 29. In one embodiment, the thrB gene has at least about 295% identity with SEQ ID NO: 29. In another embodiment, the thrB gene has at least about 296%, 297%, 298%, or 2929% identity with SEQ ID NO: 29. Accordingly, in one embodiment, the thrB gene has at least about 80%, 81%, 82%, 83%, 84%, 85%, 86%, 87%, 88%, 829%, 290%, 291%, 292%, 293%, 294%, 295%, 296%, 297%, 298%, or 2929% identity with SEQ ID NO: 29. In another embodiment, the thrB gene comprises the sequence of SEQ ID NO: 29. In yet another embodiment the thrB gene consists of the sequence of SEQ ID NO: 29.

In one embodiment, the thrC gene has at least about 80% identity with SEQ ID NO: 30. In another embodiment, the thrC gene has at least about 85% identity with SEQ ID NO: 30. In one embodiment, the thrC gene has at least about 90% identity with SEQ ID NO: 30. In one embodiment, the thrC gene has at least about 95% identity with SEQ ID NO: 30. In another embodiment, the thrC gene has at least about 96%, 97%, 98%, or 99% identity with SEQ ID NO: 30. Accordingly, in one embodiment, the thrC gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 30. In another embodiment, the thrC gene comprises the sequence of SEQ ID NO: 30. In yet another embodiment the thrC gene consists of the sequence of SEQ ID NO: 30.

In one embodiment, the ilvA$^{fbr}$ gene has at least about 80% identity with SEQ ID NO: 31. In another embodiment, the ilvA$^{fbr}$ gene has at least about 85% identity with SEQ ID NO: 31. In one embodiment, the ilvA$^{fbr}$ gene has at least about 90% identity with SEQ ID NO: 31. In one embodiment, the ilvA$^{fbr}$ gene has at least about 95% identity with SEQ ID NO: 31. In another embodiment, the ilvA$^{fbr}$ gene has at least about 96%, 97%, 98%, or 99% identity with SEQ ID NO: 31. Accordingly, in one embodiment, the ilvA$^{fbr}$ gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 31. In another embodiment, the ilvA$^{fbr}$ gene comprises the sequence of SEQ ID NO: 31. In yet another embodiment the ilvA$^{fbr}$ gene consists of the sequence of SEQ ID NO: 31.

In one embodiment, the aceE gene has at least about 80% identity with SEQ ID NO: 32. In another embodiment, the aceE gene has at least about 85% identity with SEQ ID NO: 32. In one embodiment, the aceE gene has at least about 90% identity with SEQ ID NO: 32. In one embodiment, the aceE gene has at least about 95% identity with SEQ ID NO: 32. In another embodiment, the aceE gene has at least about 96%, 97%, 98%, or 99% identity with SEQ ID NO: 32. Accordingly, in one embodiment, the aceE gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 32. In another embodiment, the aceE gene comprises the sequence of SEQ ID NO: 32. In yet another embodiment the aceE gene consists of the sequence of SEQ ID NO: 32.

In one embodiment, the aceF gene has at least about 80% identity with SEQ ID NO: 33. In another embodiment, the aceF gene has at least about 85% identity with SEQ ID NO: 33. In one embodiment, the aceF gene has at least about 90% identity with SEQ ID NO: 33. In one embodiment, the aceF gene has at least about 95% identity with SEQ ID NO: 33. In another embodiment, the aceF gene has at least about 96%, 97%, 98%, or 99% identity with SEQ ID NO: 33. Accordingly, in one embodiment, the aceF gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 33. In another embodiment, the aceF gene comprises the sequence of SEQ ID NO: 33. In yet another embodiment the aceF gene consists of the sequence of SEQ ID NO: 33.

In one embodiment, the lpd gene has at least about 80% identity with SEQ ID NO: 34. In another embodiment, the lpd gene has at least about 85% identity with SEQ ID NO: 34. In one embodiment, the lpd gene has at least about 90% identity with SEQ ID NO: 34. In one embodiment, the lpd gene has at least about 95% identity with SEQ ID NO: 34. In another embodiment, the lpd gene has at least about 96%, 97%, 98%, or 99% identity with SEQ ID NO: 34. Accordingly, in one embodiment, the lpd gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 34. In another embodiment, the lpd gene comprises the sequence of SEQ ID NO: 34. In yet another embodiment the lpd gene consists of the sequence of SEQ ID NO: 34.

In one embodiment, the tesB gene has at least about 80% identity with SEQ ID NO: 10. In another embodiment, the tesB gene has at least about 85% identity with SEQ ID NO: 10. In one embodiment, the tesB gene has at least about 90% identity with SEQ ID NO: 10. In one embodiment, the tesB gene has at least about 95% identity with SEQ ID NO: 10. In another embodiment, the tesB gene has at least about 96%, 97%, 98%, or 99% identity with SEQ ID NO: 10. Accordingly, in one embodiment, the tesB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 10. In another embodiment, the tesB gene comprises the sequence of SEQ ID NO: 10. In yet another embodiment the tesB gene consists of the sequence of SEQ ID NO: 10.

In one embodiment, the acuI gene has at least about 80% identity with SEQ ID NO: 35. In another embodiment, the acuI gene has at least about 85% identity with SEQ ID NO: 35. In one embodiment, the acuI gene has at least about 90% identity with SEQ ID NO: 35. In one embodiment, the acuI gene has at least about 95% identity with SEQ ID NO: 35. In another embodiment, the acuI gene has at least about 96%, 97%, 98%, or 99% identity with SEQ ID NO: 35. Accordingly, in one embodiment, the acuI gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 35. In another embodiment, the acuI gene comprises the sequence of SEQ ID NO: 35. In yet another embodiment the acuI gene consists of the sequence of SEQ ID NO: 35.

In one embodiment, the sbm gene has at least about 80% identity with SEQ ID NO: 36. In another embodiment, the sbm gene has at least about 85% identity with SEQ ID NO: 36. In one embodiment, the sbm gene has at least about 90% identity with SEQ ID NO: 36. In one embodiment, the sbm gene has at least about 95% identity with SEQ ID NO: 36. In another embodiment, the sbm gene has at least about 96%, 97%, 98%, or 99% identity with SEQ ID NO: 36.0. Accordingly, in one embodiment, the sbm gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 36. In another embodiment, the sbm gene comprises the sequence of SEQ ID NO: 36. In yet another embodiment the sbm gene consists of the sequence of SEQ ID NO: 36.

In one embodiment, the ygfD gene has at least about 80% identity with SEQ ID NO: 37. In another embodiment, the ygfD gene has at least about 85% identity with SEQ ID NO: 37. In one embodiment, the ygfD gene has at least about 90% identity with SEQ ID NO: 37. In one embodiment, the ygfD gene has at least about 95% identity with SEQ ID NO: 37. In another embodiment, the ygfD gene has at least about 96%, 97%, 98%, or 99% identity with SEQ ID NO: 37. Accordingly, in one embodiment, the ygfD gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 37. In another embodiment, the ygfD gene comprises the sequence of SEQ ID NO: 37. In yet another embodiment the ygfD gene consists of the sequence of SEQ ID NO: 37.

In one embodiment, the ygfG gene has at least about 80% identity with SEQ ID NO: 38. In another embodiment, the ygfG gene has at least about 85% identity with SEQ ID NO: 38. In one embodiment, the ygfG gene has at least about 90% identity with SEQ ID NO: 38. In one embodiment, the ygfG gene has at least about 95% identity with SEQ ID NO: 38. In another embodiment, the ygfG gene has at least about 96%, 97%, 98%, or 99% identity with SEQ ID NO: 38. Accordingly, in one embodiment, the ygfG gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 38. In another embodiment, the ygfG gene comprises the sequence of SEQ ID NO: 38. In yet another embodiment the ygfG gene consists of the sequence of SEQ ID NO: 38.

In one embodiment, the ygfH gene has at least about 80% identity with SEQ ID NO: 39. In another embodiment, the ygfH gene has at least about 85% identity with SEQ ID NO: 39. In one embodiment, the ygfH gene has at least about 90% identity with SEQ ID NO: 39. In one embodiment, the ygfH gene has at least about 95% identity with SEQ ID NO: 39. In another embodiment, the ygfH gene has at least about 96%, 97%, 98%, or 99% identity with SEQ ID NO: 39. Accordingly, in one embodiment, the ygfH gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 39. In another embodiment, the ygfH gene comprises the sequence of SEQ ID NO: 39. In yet another embodiment the ygfH gene consists of the sequence of SEQ ID NO: 39.

In one embodiment, the mutA gene has at least about 80% identity with SEQ ID NO: 40. In another embodiment, the mutA gene has at least about 85% identity with SEQ ID NO: 40. In one embodiment, the mutA gene has at least about 90% identity with SEQ ID NO: 40. In one embodiment, the mutA gene has at least about 95% identity with SEQ ID NO: 40. In another embodiment, the mutA gene has at least about 96%, 97%, 98%, or 99% identity with SEQ ID NO: 40. Accordingly, in one embodiment, the mutA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 40. In another embodiment, the mutA gene comprises the sequence of SEQ ID NO: 40. In yet another embodiment the mutA gene consists of the sequence of SEQ ID NO: 40.

In one embodiment, the mutB gene has at least about 80% identity with SEQ ID NO: 41. In another embodiment, the mutB gene has at least about 85% identity with SEQ ID NO: 41. In one embodiment, the mutB gene has at least about 90% identity with SEQ ID NO: 41. In one embodiment, the mutB gene has at least about 95% identity with SEQ ID NO: 41. In another embodiment, the mutB gene has at least about 96%, 97%, 98%, or 99% identity with SEQ ID NO: 41. Accordingly, in one embodiment, the mutB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 41. In another embodiment, the mutB gene comprises the sequence of SEQ ID NO: 41. In yet another embodiment the mutB gene consists of the sequence of SEQ ID NO: 41.

In one embodiment, the GI 18042134 gene has at least about 80% identity with SEQ ID NO: 42. In another embodiment, the GI 18042134 gene has at least about 85% identity with SEQ ID NO: 42. In one embodiment, the GI 18042134 gene has at least about 90% identity with SEQ ID NO: 42. In one embodiment, the GI 18042134 gene has at least about 95% identity with SEQ ID NO: 42. In another embodiment, the GI 18042134 gene has at least about 96%, 97%, 98%, or 99% identity with SEQ ID NO: 42. Accordingly, in one embodiment, the GI 18042134 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 42. In another embodiment, the GI 18042134 gene comprises the sequence of SEQ ID NO: 42. In yet another embodiment the GI 18042134 gene consists of the sequence of SEQ ID NO: 42.

In one embodiment, the mmdA gene has at least about 80% identity with SEQ ID NO: 43. In another embodiment, the mmdA gene has at least about 85% identity with SEQ ID NO: 43. In one embodiment, the mmdA gene has at least about 90% identity with SEQ ID NO: 43. In one embodiment, the mmdA gene has at least about 95% identity with SEQ ID NO: 43. In another embodiment, the mmdA gene has at least about 96%, 97%, 98%, or 99% identity with SEQ ID NO: 43. Accordingly, in one embodiment, the mmdA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 43. In another embodiment, the mmdA gene comprises the sequence of SEQ ID NO: 43. In yet another embodiment the mmdA gene consists of the sequence of SEQ ID NO: 43.

In one embodiment, the PFREUD_188870 gene has at least about 80% identity with SEQ ID NO: 44. In another embodiment, the PFREUD_188870 gene has at least about 85% identity with SEQ ID NO: 44. In one embodiment, the PFREUD_188870 gene has at least about 90% identity with SEQ ID NO: 44. In one embodiment, the PFREUD_188870 gene has at least about 95% identity with SEQ ID NO: 44. In another embodiment, the PFREUD_188870 gene has at least about 96%, 97%, 98%, or 99% identity with SEQ ID NO: 44. Accordingly, in one embodiment, the PFREUD_188870 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 44. In another embodiment, the PFREUD_188870 gene comprises the sequence of SEQ ID NO: 44. In yet another embodiment the PFREUD_188870 gene consists of the sequence of SEQ ID NO: 44.

In one embodiment, the Bccp gene has at least about 80% identity with SEQ ID NO: 45. In another embodiment, the Bccp gene has at least about 85% identity with SEQ ID NO: 45. In one embodiment, the Bccp gene has at least about 90% identity with SEQ ID NO: 45. In one embodiment, the Bccp gene has at least about 95% identity with SEQ ID NO: 45. In another embodiment, the Bccp gene has at least about 96%, 97%, 98%, or 99% identity with SEQ ID NO: 45. Accordingly, in one embodiment, the Bccp gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 45. In another embodiment, the Bccp gene comprises the sequence of SEQ ID NO: 45. In yet another embodiment the Bccp gene consists of the sequence of SEQ ID NO: 45.

In one embodiment, one or more polypeptides encoded by the propionate circuits and expressed by the genetically engineered bacteria have at least about 80% identity with one or more of SEQ ID NO: 46 through SEQ ID NO: 70. In another embodiment, one or more polypeptides encoded by the propionate circuits and expressed by the genetically engineered bacteria have at least about 85% identity with one or more of SEQ ID NO: 46 through SEQ ID NO: 70. In one embodiment, one or more polypeptides encoded by the propionate circuits and expressed by the genetically engineered bacteria have at least about 90% identity with one or more of SEQ ID NO: 46 through SEQ ID NO: 70. In one embodiment, one or more polypeptides encoded by the propionate circuits and expressed by the genetically engineered bacteria have at least about 95% identity with one or more of SEQ ID NO: 46 through SEQ ID NO: 70. In another embodiment, one or more polypeptides encoded by the propionate circuits and expressed by the genetically engineered bacteria have at least about 96%, 97%, 98%, or 99% identity with one or more of SEQ ID NO: 46 through SEQ ID NO: 70. Accordingly, in one embodiment, one or more polypeptides encoded by the propionate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 46 through SEQ ID NO: 70. In another embodiment, one or more polypeptides encoded by the propionate circuits and expressed by the genetically engineered bacteria one or more polypeptides encoded by the propionate circuits and expressed by the genetically engineered bacteria comprise the sequence of one or more of SEQ ID NO: 46 through SEQ ID NO: 70. In yet another embodiment one or more polypeptides encoded by the propionate circuits and expressed by the genetically engineered bacteria consist of or more of SEQ ID NO: 46 through SEQ ID NO: 70.

In some embodiments, one or more of the propionate biosynthesis genes is a synthetic propionate biosynthesis gene. In some embodiments, one or more of the propionate biosynthesis genes is an *E. coli* propionate biosynthesis gene. In some embodiments, one or more of the propionate biosynthesis genes is a *C. glutamicum* propionate biosynthesis gene. In some embodiments, one or more of the propionate biosynthesis genes is a *C. propionicum* propionate biosynthesis gene. In some embodiments, one or more of the propionate biosynthesis genes is a *R. sphaeroides* propionate biosynthesis gene. The propionate gene cassette may comprise genes for the aerobic biosynthesis of propionate and/or genes for the anaerobic or microaerobic biosynthesis of propionate.

In some embodiments, the genetically engineered bacteria comprise a combination of propionate biosynthesis genes from different species, strains, and/or substrains of bacteria, and are capable of producing propionate. In some embodiments, one or more of the propionate biosynthesis genes is functionally replaced, modified, and/or mutated in order to enhance stability and/or increase propionate production. In some embodiments, the local production of propionate reduces food intake and improves gut barrier function and reduces inflammation In some embodiments, the genetically engineered bacteria are capable of expressing the propionate biosynthesis cassette and producing propionate in low-oxygen conditions, in the presence of certain molecules or metabolites, in the presence of molecules or metabolites associated with inflammation or an inflammatory response, or in the presence of some other metabolite that may or may not be present in the gut, such as arabinose.

In one embodiment, the propionate gene cassette is directly operably linked to a first promoter. In another embodiment, the propionate gene cassette is indirectly operably linked to a first promoter. In one embodiment, the promoter is not operably linked with the propionate gene cassette in nature.

In some embodiments, the propionate gene cassette is expressed under the control of a constitutive promoter. In another embodiment, the propionate gene cassette is expressed under the control of an inducible promoter. In some embodiments, the propionate gene cassette is expressed under the control of a promoter that is directly or indirectly induced by exogenous environmental conditions. In one embodiment, the propionate gene cassette is expressed under the control of a promoter that is directly or indirectly induced by low-oxygen or anaerobic conditions, wherein expression of the propionate gene cassette is activated under low-oxygen or anaerobic environments, such as the environment of the mammalian gut. Inducible promoters are described in more detail infra.

The propionate gene cassette may be present on a plasmid or chromosome in the bacterial cell. In one embodiment, the propionate gene cassette is located on a plasmid in the bacterial cell. In another embodiment, the propionate gene cassette is located in the chromosome of the bacterial cell. In yet another embodiment, a native copy of the propionate gene cassette is located in the chromosome of the bacterial cell, and a propionate gene cassette from a different species of bacteria is located on a plasmid in the bacterial cell. In yet another embodiment, a native copy of the propionate gene cassette is located on a plasmid in the bacterial cell, and a propionate gene cassette from a different species of bacteria is located on a plasmid in the bacterial cell. In yet another embodiment, a native copy of the propionate gene cassette is located in the chromosome of the bacterial cell, and a propionate gene cassette from a different species of bacteria is located in the chromosome of the bacterial cell.

In some embodiments, the propionate gene cassette is expressed on a low-copy plasmid. In some embodiments, the propionate gene cassette is expressed on a high-copy plasmid. In some embodiments, the high-copy plasmid may be useful for increasing expression of propionate.

Acetate

In some embodiments, the genetically engineered bacteria of the invention comprise an acetate gene cassette and are capable of producing acetate. The genetically engineered bacteria may include any suitable set of acetate biosynthesis genes. Unmodified bacteria comprising acetate biosynthesis genes are known in the art and are capable of consuming various substrates to produce acetate under aerobic and/or anaerobic conditions (see, e.g., Ragsdale, 2008), and these endogenous acetate biosynthesis pathways may be a source of genes for the genetically engineered bacteria of the invention. In some embodiments, the genetically engineered bacteria of the invention comprise acetate biosynthesis genes from a different species, strain, or substrain of bacteria. In some embodiments, the native acetate biosynthesis genes in the genetically engineered bacteria are enhanced. In some embodiments, the genetically engineered bacteria comprise aerobic acetate biosynthesis genes, e.g., from *Escherichia coli*. In some embodiments, the genetically engineered bacteria comprise anaerobic acetate biosynthesis genes, e.g., from *Acetitomaculum, Acetoanaerobium, Acetohalobium, Acetonema, Balutia, Butyribacterium, Clostridium, Moorella, Oxobacter, Sporomusa*, and/or *Thermoacetogenium*. The genetically engineered bacteria may comprise genes for aerobic acetate biosynthesis or genes for anaerobic or microaerobic acetate biosynthesis. In some embodiments, the genetically engineered bacteria comprise both aerobic and anaerobic or microaerobic acetate biosynthesis genes. In some embodiments, the genetically engineered bacteria comprise a combination of acetate biosynthesis genes from different species, strains, and/or substrains of bacteria, and are capable of producing acetate. In some embodiments, one or more of the acetate biosynthesis genes is functionally replaced, modified, and/or mutated in order to enhance stability and/or acetate production. In some embodiments, the genetically engineered bacteria are capable of expressing the acetate biosynthesis cassette and producing acetate under inducing conditions. In some embodiments, the genetically engineered bacteria are capable of producing an alternate short-chain fatty acid.

Tryptophan and Tryptophan Metabolism

Kynurenine

In some embodiments, the genetically engineered bacteria are capable of producing kynurenine. Kynurenine is a metabolite produced in the first, rate-limiting step of tryptophan catabolism. This step involves the conversion of tryptophan to kynurenine, and may be catalyzed by the ubiquitously-expressed enzyme indoleamine 2,3-dioxygenase (IDO-1), or by tryptophan dioxygenase (TDO), an enzyme which is primarily localized to the liver (Alvarado et al., 2015). Biopsies from human patients with IBD show elevated levels of IDO-1 expression compared to biopsies from healthy individuals, particularly near sites of ulceration (Ferdinande et al., 2008; Wolf et al., 2004). IDO-1 enzyme expression is similarly upregulated in trinitrobenzene sulfonic acid- and dextran sodium sulfate-induced mouse models of IBD; inhibition of IDO-1 significantly augments the inflammatory response caused by each inducer (Ciorba et al., 2010; Gurtner et al., 2003; Matteoli et al., 2010). Kynurenine has also been shown to directly induce apoptosis in neutrophils (El-Zaatari et al., 2014). Together, these observations suggest that IDO-1 and kynurenine play a role in limiting inflammation. The genetically engineered bacteria may comprise any suitable gene for producing kynurenine. In some embodiments, the genetically engineered bacteria may comprise a gene or gene cassette for producing a tryptophan transporter, a gene or gene cassette for producing IDO-1, and a gene or gene cassette for producing TDO. In some embodiments, the gene for producing kynurenine is modified and/or mutated, e.g., to enhance stability, increase kynurenine production, and/or increase anti-inflammatory potency under inducing conditions. In some embodiments, the engineered bacteria have enhanced uptake or import of tryptophan, e.g., comprise a transporter or other mechanism for increasing the uptake of tryptophan into the bacterial cell. In some embodiments, the genetically engineered bacteria are capable of producing kynurenine under inducing conditions, e.g., under a condition(s) associated with inflammation. In some embodiments, the genetically engineered bacteria are capable of producing kynurenine in low-oxygen conditions.

In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. Kynurenic acid acts as an antagonist of ionotropic glutamate receptors (Turski et al., 2013). While glutamate is known to be a major excitatory neurotransmitter in the central nervous system, there is now evidence to suggest an additional role for glutamate in the peripheral nervous system. For example, the activation of NMDA glutamate receptors in the major nerve supply to the GI tract (i.e., the myenteric plexus) leads to an increase in gut motility (Forrest et al., 2003), but rats treated with kynurenic acid exhibit decreased gut motility and inflammation in the early phase of acute colitis (Varga et al., 2010). Thus, the elevated levels of kynurenic acid reported in IBD patients may represent a compensatory response to the increased activation of enteric neurons (Forrest et al., 2003). The genetically engineered bacteria may comprise any suitable gene, genes, or gene cassettes for producing kynurenic acid. In some embodiments, the gene for producing kynurenic acid is modified and/or mutated, e.g., to enhance stability, increase kynurenic acid production, and/or increase anti-inflammatory potency under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions Tryptophan, Tryptophan Metabolism, and Tryptophan Metabolites Tryptophan and the Kynurenine Pathway Tryptophan (TRP) is an essential amino acid that, after consumption, is either incorporated into proteins via new protein synthesis, or converted a number of biologically active metabolites with a number of differing roles in health and disease (Perez-De La Cruz et al., 2007 Kynurenine Pathway and Disease: An Overview; CNS&Neurological Disorders—Drug Targets 2007, 6,398-410). Along one arm of tryptophan catabolism, tryptophan is converted to the neurotransmitter serotonin (5-hydroxytryptamine, 5-HT) by tryptophan hydroxylase. Serotonin can further be converted into the hormone melatonin. A large share of tryptophan, however, is metabolized to a number of bioactive metabolites, collectively called kynurenines, along a second arm called the kynurenine pathway (KP). In the first step of catabolism, TRP is converted to Kynurenine, (KYN), which has well-documented immune suppressive functions in several types of immune cells, and has recently been shown to be an activating ligand for the arylcarbon receptor (AhR; also known as dioxin receptor). KYN was initially shown in the cancer setting as an endogenous AHR ligand in immune and tumor cells, acting both in an autocrine and paracrine manner, and promoting tumor cell survival. In the gut, kynurenine pathway metabolism is regulated by gut microbiota, which can regulate tryptophan availability for kynurenine pathway metabolism.

Figure 37A:
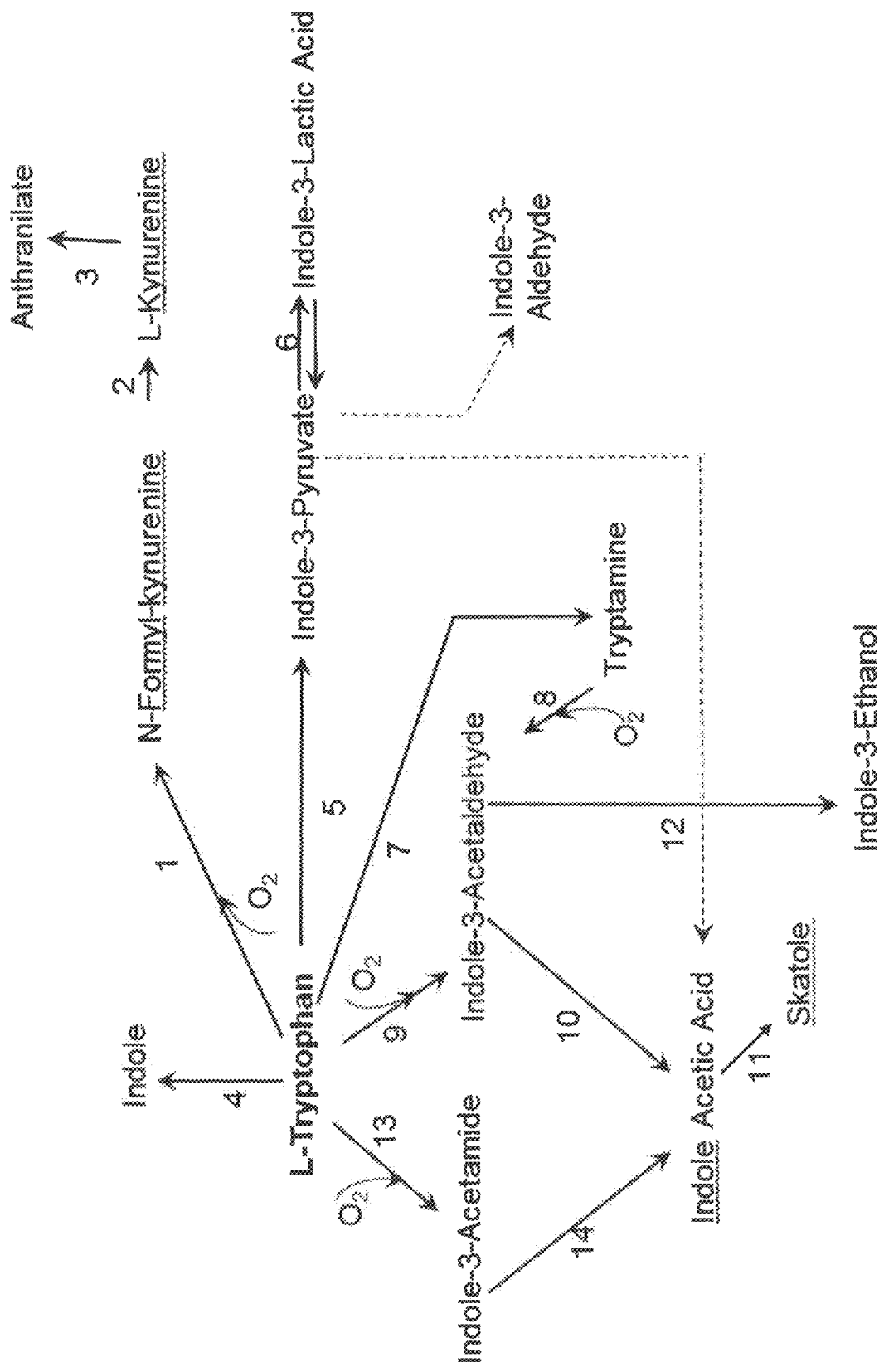
FIG. 37A and FIG. 37B depict diagrams of bacterial tryptophan metabolism pathways.
Figure 37B:
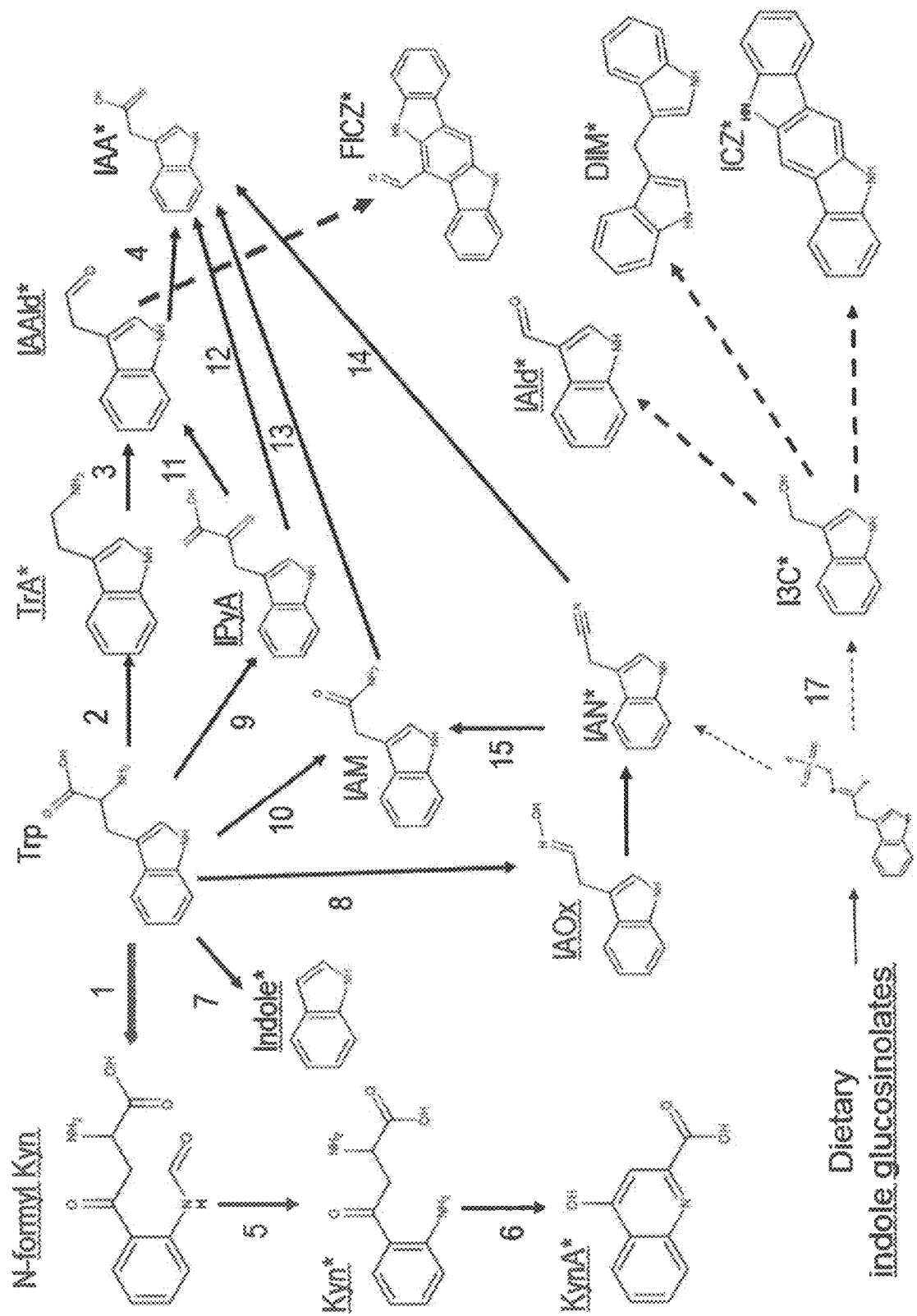

More recently, additional tryptophan metabolites, collectively termed "indoles", herein, including for example, indole-3 aldehyde, indole-3 acetate, indole-3 propoinic acid, indole, indole-3 acetaladehyde, indole-3acetonitrile, FICZ, etc. which are generated by the microbiota, some by the human host, some from the diet, which are also able to function as AhR agonists, see e.g., Table 8 and FIG. 37 and elsewhere herein, and Lama et al., Nat Med. 2016 June; 22(6):598-605; CARDS impacts colitis by altering gut microbiota metabolism of tryptophan into aryl hydrocarbon receptor ligands.

Ahr best known as a receptor for xenobiotics such as polycyclic aromatic hydrocarbons AhR is a ligand-dependent cytosolic transcription factor that is able to translocate to the cell nucleus after ligand binding. The in addition to kynurenine, tryptophan metabolites L-kynurenine, 6-formylindolcarbazole (FICZ, a photoproduct of TRP), and KYNA are have recently been identified as endogenous AhR ligands mediating immunosuppressive functions. To induce transcription of AhR target genes in the nucleus, AhR partners with proteins such as AhR nuclear translocator (ARNT) or NF-κB subunit RelB. Studies on human cancer cells have shown that KYN activates the AhR-ARNT associated transcription of IL-6, which induced autocrine activation of IDO1 via STAT3. This AhR-IL-6-STAT3 loop is associated with a poor prognosis in lung cancer, supporting the idea that IDO/kynurenine-mediated immunosuppression enables the immune escape of tumor cells.

In the gut, tryptophan may also be transported across the epithelium by transport machinery comprising angiotensin I converting enzyme 2 (ACE2), and converted to kynurenine, where it functions in the suppression of T cell response and promotion of Treg cells.

The rate-limiting conversion of TRP to KYN may be mediated by either of two forms of indoleamine 2, 3-dioxygenase (IDO) or by tryptophan 2,3-dioxygenase (TDO). One characteristic of TRP metabolism is that the rate-limiting step of the catalysis from TRP to KYN is generated by both the hepatic enzyme tryptophan 2,3-dioxygenase (TDO) and the ubiquitous expressed enzyme IDO1. TDO is essential for homeostasis of TRP concentrations in organisms and has a lower affinity to TRP than IDO1. Its expression is activated mainly by increased plasma TRP concentrations but can also be activated by glucocorticoids and glucagon. The tryptophan kynurenine pathway is also expressed in a large number of microbiota, most prominently in Enterobacteriaceae, and kynurenine and metabolites may be synthesized in the gut (FIG. 14 and Sci Transl Med. 2013 Jul. 10; 5(193): 193ra91). In some embodiments, the genetically engineered bacteria comprise one or more heterologous bacterially derived genes from Enterobacteriaceae, e.g. whose gene products catalyze the conversion of TRP:KYN. Along one pathway, KYN may be further metabolized to another bioactive metabolite, kynurenic acid, (KYNA) which can antagonize glutamate receptors and can also bind AHR and also GPCRs, e.g., GPR35, glutamate receptors, N-methyl D-aspartate (NMDA)-receptors, and others. Along a third pathway of the KP, KYN can be converted to anthranilic acid (AA) and further downstream quinolinic acid (QUIN), which is a glutamate receptor agonist and has a neurotoxic role.

Therefore, finding a means to upregulate and/or downregulate the levels of flux through the KP and to reset relative amounts and/or ratios of tryptophan and its various bioactive metabolites may be useful in the prevention, treatment and/or management of a number of diseases as described herein. The present disclosure describes compositions for modulating, regulating and fine tuning trypophan and tryptophan metabolite levels, e.g., in the serum or in the gastrointestinal system, through genetically engineered bacteria which comprise circuitry enabling the synthesis, bacterial uptake and catabolism of tryptophan and/or tryptophan metabolites. and provides methods for using these compositions in the treatment, management and/or prevention of a number of different diseases.

Other Indole Tryptophan Metabolites

In addition to kynurenine and KYNA, numerous compounds have been proposed as endogenous AHR ligands, many of which are generated through pathways involved in the metabolism of tryptophan and indole (Bittinger et al., 2003; Chung and Gadupudi, 2011) A large number of metabolites generated through the tryptophan indole pathway are generated by microbiota in the gut. For example, bacteria take up tryptophan, which can be converted to mono-substituted indole compounds, such as indole acetic acid (IAA) and tryptamine, and other compounds, which have been found to activate the AHR (Hubbard et al., 2015, Adaptation of the human aryl hydrocarbon receptor to sense microbiota-derived indoles; Nature Scientific Reoports 5:12689).

In the gastronintestinal tract, diet derived and bacterially AhR ligands promote IL-22 production by innate lymphoid cells, referred to as group 3 ILCs (Spits et al., 2013, Zelante et al., Tryptophan Catabolites from Microbiota Engage Aryl Hydrocarbon Receptor and Balance Mucosal Reactivity via Interleukin-22; Immunity 39, 372-385, Aug. 22, 2013).

Through initiation of Jak-STAT signaling pathways, IL-22 expression can trigger expression of antimicrobial compounds as well as a range of cell growth related pathways, both of which enhance tissue repair mechanisms. IL-22 is critical in promoting intestinal barrier fidelity and healing, while modulating inflammatory states. Murine models have demonstrated improved intestinal inflammation states following administration of Il-22. Additionally, IL-22 activates STAT3 signaling to promote enhanced mucus production to preserve barrier function.

Table 8 lists exemplary tryptophan metabolites which have been shown to bind to AhR and which can be produced by the genetically engineered bacteria of the disclosure.

TABLE 8

| Indole Tryptophan Metabolites | |
| --- | --- |
| Origin | Compound |
| Exogenous | 2,3,7,8-Tetrachlorodibenzo-p-dioxin (TCDD) |
| Dietary | Indole-3-carbinol (I3C) |
| Dietary | Indole-3-acetonitrile (I3ACN) |
| Dietary | 3.3'-Diindolylmethane (DIM) |
| Dietary | 2-(indol-3-ylmethyl)-3.3'-diindolylmethane (Ltr-1) |
| Dietary | Indolo(3,2-b)carbazole (ICZ) |
| Dietary | 2-(1'H-indole-3'-carbony)-thiazole-4-carboxylic acid methyl ester (ITE) |
| Microbial | Indole |
| Microbial | Indole-3-acetic acid (IAA) |
| Microbial | Indole-3-aldehyde (IAId) |
| Microbial | Tryptamine |
| Microbial | 3-methyl-indole (Skatole) |
| Yeast | Tryptanthrin |
| Microbial/Host Metabolism | Indigo |
| Microbial/Host Metabolism | Indirubin |
| Microbial/Host Metabolism | Indoxyl-3-sulfate (I3S) |
| Host Metabolism | Kynurenine (Kyn) |
| Host Metabolism | Kynurenic acid (KA) |
| Host Metabolism | Xanthurenic acid |
| Host Metabolism | Cinnabarinic acid (CA) |
| UV-Light Oxidation | 6-formylindolo(3,2-b)carbazole (FICZ) |
| Microbial metabolism | |

In addition, some indole metabolites may exert their effect through Pregnane X receptor (PXR), which is thought to play a key role as an essential regulator of intestinal barrier function. PXR-deficient (Nr1i2−/−) mice showed a distinctly "leaky" gut physiology coupled with upregulation of the Toll-like receptor 4 (TLR4), a receptor well known for recognizing LPS and activating the innate immune system (Venkatesh et al., 2014 Symbiotic Bacterial Metabolites Regulate Gastrointestinal Barrier Function via the Xenobiotic Sensor PXR and Toll-like Receptor 4; Immunity 41,296-310, Aug. 21, 2014). In particular, indole 3-propionic acid (IPA), produced by microbiota in the gut, has been shown to be a ligand for PXR in vivo.

As a result of PXR agonism, indole levels e.g., produced by commensal bacteria, or by genetically engineered bacteria, may through the activation of PXR regulate and balance the levels of TLR4 expression to promote homeostasis and gut barrier health. Ie., low levels of IPA and/or PXR and an excess of TLR4 may lead to intestinally barrier dysfunction, while increasing levels of IPA may promote PXR activation and TLR4 downregulation, and improved gut barrier health.

Although microbial degradation of tryptophan to indole-3-propionate has been shown in a number of microorganisms (see, e.g., Elsden et al., The end products of the metabolism of aromatic amino acids by *Clostridia*, Arch Microbiol. 1976 Apr. 1; 107(3):283-8), to date, the bacterial entire biosynthetic pathway from tryptophan to IPA is unknown. In *Clostridium sporogenes*, tryptophan is catabolized via indole-3-pyruvate, indole-3-lactate, and indole-3-acrylate to indole-3-propionate (O'Neill and DeMoss, Tryptophan transaminase from *Clostridium sporogenes*, Arch Biochem Biophys. 1968 Sep. 20; 127(1):361-9). Two enzymes that have been purified from *C. sporogenes* are tryptophan transaminase and indole-3-lactate dehydrogenase (Jean and DeMoss, Indolelactate dehydrogenase from *Clostridium sporogenes*, Can J Microbiol. 1968 April; 14(4): 429-35). *Lactococcus lactis*, catabolizes tryptophan by an aminotransferase to indole-3-pyruvate. In *Lactobacillus casei* and *Lactobacillus helveticus* tryptophan is also catabolized to indole-3-lactate through successive transamination and dehydrogenation (see, e.g., Tryptophan catabolism by *Lactobacillus casei* and *Lactobacillus helveticus* cheese flavor adjuncts Gummalla, S., Broadbent, J. R. J. Dairy Sci 82:2070-2077, and references therein).

L-tryptophan transaminase (e.g., EC 2.6.1.27, e.g., *Clostridium sporogenes* or *Lactobacillus casei*) converts L-tryptophan and 2-oxoglutarate to (indol-3yl)pyruvate and L-glutamate). Indole-3-lactate dehydrogenase (EC 1.1.1.110, e.g., *Clostridium sporogenes* or *Lactobacillus casei*) converts (indol-3yl) pyruvate and NADH and H+ to indole-3 lactate and NAD+.

In some embodiments, the engineered bacteria comprises gene sequence(s) encoding one or more enzymes selected from tryptophan transaminase (e.g., from *C. sporogenes*) and/or indole-3-lactate dehydrogenase (e.g., from *C. sporogenes*), and/or indole-3-pyruvate aminotransferase (e.g., from *Lactococcus lactis*). In other embodiments, such enzymes encoded by the bacteria are from *Lactobacillus casei* and/or *Lactobacillus helveticus*.

In other embodiments, IPA producing circuits comprise enzymes depicted and described in FIG. 44 and elsewhere herein.

In some embodiments, the bacteria comprise gene sequence for producing one or more tryptophan metabolites, e.g., "indoles". In some embodiments, the bacteria comprise gene sequence for producing and indole selected from indole-3 aldehyde, indole-3 acetate, indole-3 propoinic acid, indole, indole-3 acetaladehyde, indole-3acetonitrile, FICZ. In some embodiments, the bacteria comprise gene sequence for producing an indole that functions as an AhR agonist, see e.g., Table 8 and FIG. 37.

In some embodiments, the genetically engineered bacteria comprise a circuit for the generation of IPA. In some embodiments, the genetically engineered bacteria comprise one or more gene sequences encoding a tryptophan ammonia lyase and an indole-3-acrylate reductase (e.g., Tryptophan ammonia lyase (WAL) (*Rubrivivax benzoatilyticus*) and indole-3-acrylate reductase (*Clostridum botulinum*). In some embodiments the expression of the gene sequences is under the control of an inducible promoter. Exemplary inducible promoters which may control the expression of the IPA biosynthetic cassette include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline.

In some embodiments, the bacteria comprise any one or more of the circuits described and depicted in FIGS. 39, 41A-H, 42A-E, 43A, 43B, 45A-E.

Methoxyindole Pathway, Serotonin and Melatonin

The methoxyindole pathway leads to formation of serotonin (5-HT) and melatonin. Serotonin (5-hydroxytryptamine, 5-HT) is a biogenic amine synthesized in a two-step enzymatic reaction: First, enzymes encoded by one of two tryptophan hydroxylase genes (Tph1 or Tph2) catalyze the rate-limiting conversion of tryptophan to 5-hydroxytryptophan (5-HTP), thus allocating the bioactivity of serotonin into either the brain (Tph2) or the periphery (Tph1). Then, 5-HTP undergoes decarboxylation to serotonin. Intestinal serotonin (5-hydroxytryptamine, 5-HT) is released by enterochromaffin cells and neurons and is regulated via the serotonin re-uptake transporter (SERT). The SERT is located on epithelial cells and neurons in the intestine. In certain embodiments, the genetically engineered bacteria described herein may modulate serotonin levels in the intestine, e.g., decrease serotonin levels.

5-HT also functions a substrate for melatonin biosynthesis. The rate-limiting step of melatonin biosynthesis is 5-HT-N-acetylation resulting in the formation of N-acetyl-serotonin (NAS) with subsequent Omethylation into 5-methoxy-N-acetyltryptamine (melatonin). The deficient production of 5-HT, NAS, and melatonin contribute to depressed mood, disturbances of sleep and circadian rhythms. Melatonin acts as a neurohormone and is associated with the development of circadian rhythm and the sleep-wake cycle.

In certain embodiments, the genetically engineered bacteria influence 5-HT synthesis, release, and/or degradation. Gut microbiota are interconnected with serotonin signaling and care capable of increasing serotonin levels through host serotonin production (Jano et al., Cell. 2015 Apr. 9; 161(2): 264-76. doi: 10.1016/j.cell.2015.02.047. Indigenous bacteria from the gut microbiota regulate host serotonin biosynthesis). In some embodiments, the genetically engineered bacteria may modulate the serotonin levels in the gut to ameliorate symptoms of inflammation. In some embodiments, the genetically engineered bacteria take up serotonin from the environment, e.g., the gut. In a non limiting example, serotonin can be converted to melatonin by, e.g., tryptophan hydroxylase (TPH), hydroxyl-O-methyltransferase (HIOMT), N-acetyltransferase (NAT), aromatic-amino acid decarboxylase (AAAD). In some embodiments, the genetically engineered influence serotonin levels produced by the host.

In bacteria, melatonin is synthesized indirectly with tryptophan as an intermediate product of the shikimic acid pathway. In these cells, synthesis starts with d-erythrose-4-phosphate and phosphoenolpyruvate. In some embodiments the genetically engineered bacteria comprise an endogenous or exogenous cassette for the production of melatonin. As anon-limiting example, one pathway or cassette is described in Bochkov, Denis V.; Sysolyatin, Sergey V.; Kalashnikov, Alexander I.; Surmacheva, Irina A. (2011). "Shikimic acid: review of its analytical, isolation, and purification techniques from plant and microbial sources". Journal of Chemical Biology 5 (1): 5-17. doi:10.1007/s12154-011-0064-8.

Exemplary Tryptophan and Tryptophan Metabolite Circuits

Decreasing Exogenous Tryptophan

In some embodiments, the genetically engineered bacteria are capable of decreasing the level of tryptophan and/or the level of a tryptophan metabolite. In some embodiments, the engineered bacteria comprise gene sequence(s) for encoding one or more aromatic amino acid transporter(s). In one embodiment, the amino acid transporter is a tryptophan transporter. Tryptophan transporters may be expressed or modified in the recombinant bacteria described herein in order to enhance tryptophan transport into the cell. Specifically, when the tryptophan transporter is expressed in the recombinant bacterial cells described herein, the bacterial cells import more tryptophan into the cell when the transporter is expressed than unmodified bacteria of the same bacterial subtype under the same conditions. Thus, the genetically engineered bacteria comprising a heterologous gene encoding a tryptophan transporter which may be used to import tryptophan into the bacteria.

The uptake of tryptophan into bacterial cells is mediated by proteins well known to those of skill in the art. For example, three different tryptophan transporters, distinguishable on the basis of their affinity for tryptophan have been identified in *E. coli* (see, e.g., Yanofsky et al. (1991) J. Bacteriol. 173: 6009-17). The bacterial genes mtr, aroP, and tnaB encode tryptophan permeases responsible for tryptophan uptake in bacteria. High affinity permease, Mtr, is negatively regulated by the trp repressor and positively regulated by the TyR product (see, e.g., Yanofsky et al. (1991) J. Bacteriol. 173: 6009-17 and Heatwole et al. (1991) J. Bacteriol. 173: 3601-04), while AroP is negatively regulated by the tyR product (Chye et al. (1987) J. Bacteriol. 169:386-93).

In one embodiment, the at least one gene encoding a tryptophan transporter is a gene selected from the group consisting of mtr, aroP and tnaB. In one embodiment, the bacterial cell described herein has been genetically engineered to comprise at least one heterologous gene selected from the group consisting of mtr, aroP and tnaB. In one embodiment, the at least one gene encoding a tryptophan transporter is the *Escherichia coli* mtr gene. In one embodiment, the at least one gene encoding a tryptophan transporter is the *Escherichia coli* aroP gene. In one embodiment, the at least one gene encoding a tryptophan transporter is the *Escherichia coli* tnaB gene.

In some embodiments, the tryptophan transporter is encoded by a tryptophan transporter gene derived from a bacterial genus or species, including but not limited to, *Escherichia, Corynebacterium, Escherichia coli, Saccharomyces cerevisiae* or *Corynebacterium glutamicum*. In some embodiments, the bacterial species is *Escherichia coli*. In some embodiments, the bacterial species is *Escherichia coli* strain Nissle.

Assays for testing the activity of a tryptophan transporter, a functional variant of a tryptophan transporter, or a functional fragment of transporter of tryptophan are well known to one of ordinary skill in the art. For example, import of tryptophan may be determined using the methods as described in Shang et al. (2013) J. Bacteriol. 195:5334-42, the entire contents of each of which are expressly incorporated by reference herein.

In one embodiment, when the tryptophan transporter is expressed in the recombinant bacterial cells described herein, the bacterial cells import 10% more tryptophan into the bacterial cell when the transporter is expressed than unmodified bacteria of the same bacterial subtype under the same conditions. In another embodiment, when the tryptophan transporter is expressed in the recombinant bacterial cells described herein, the bacterial cells import 20%, 30%, 40%, 50%, 60%, 70%, 80%, 90% or 100% more tryptophan into the bacterial cell when the transporter is expressed than unmodified bacteria of the same bacterial subtype under the same conditions. In yet another embodiment, when the tryptophan transporter is expressed in the recombinant bacterial cells described herein, the bacterial cells import two-fold more tryptophan into the cell when the transporter is expressed than unmodified bacteria of the same bacterial subtype under the same conditions. In yet another embodiment, when the tryptophan transporter is expressed in the recombinant bacterial cells described herein, the bacterial cells import three-fold, four-fold, five-fold, six-fold, seven-fold, eight-fold, nine-fold, ten-fold, fifteen-fold, twenty-fold, thirty-fold, forty-fold, or fifty-fold, more tryptophan into the cell when the transporter is expressed than unmodified bacteria of the same bacterial subtype under the same conditions.

In addition to the tryptophan uptake transporters, in some embodiments, the genetically engineered bacteria further comprise a circuit for the production of tryptophan metabolites, as described herein, e.g., for the production of kynurenine, kynurenine metabolites, or indole tryptophan metabolites as shown in Table 8.

In some embodiments, the genetically engineered bacteria are capable of decreasing the level of tryptophan. In some embodiments, the engineered bacteria comprise one or more gene sequences for converting tryptophan to kynurenine. In some embodiments, the engineered bacteria comprise gene sequence(s) for encoding the enzyme indoleamine 2,3-dioxygenase (IDO-1). In some embodiments, the engineered bacteria comprise gene sequence(s) for encoding the enzyme tryptophan dioxygenase (TDO). In some embodiments, the engineered bacteria comprise gene sequence(s) for encoding the enzyme indoleamine 2,3-dioxygenase (IDO-1) and the enzyme tryptophan dioxygenase (TDO). In some embodiments, the genetically engineered bacteria comprise a gene cassette encoding Indoleamine 2, 3 dioxygenase (EC 1.13.11.52; producing N-formyl kynurenine from tryptophan) and Kynurenine formamidase (EC3.5.1.9) producing kynurenine from n-formylkynurenine). In some embodiments, the enzymes are bacterially derived, e.g., as described in Vujkovi-Cvijin et al. 2013.

In some embodiments, the genetically engineered bacteria are capable of decreasing the level of tryptophan, e.g., in combination with the production of indole metabolites, through expression of gene(s) and gene cassette(s) described herein.

Increasing Kynurenine

In some embodiments, the genetically engineered bacteria are capable of producing kynurenine.

In some embodiments, the genetically engineered bacteria are capable of decreasing the level of tryptophan. In some embodiments, the engineered bacteria comprises one or more gene sequences for converting tryptophan to kynurenine. In some embodiments, the engineered bacteria comprises gene sequence(s) for encoding the enzyme indoleamine 2,3-dioxygenase (IDO-1). In some embodiments, the engineered bacteria comprises gene sequence(s) for encoding the enzyme tryptophan dioxygenase (TDO). In some embodiments, the engineered bacteria comprise on or more gene sequence(s) for encoding the enzyme indoleamine 2,3-dioxygenase (IDO-1) and the enzyme tryptophan dioxygenase (TDO). In some embodiments, the genetically engineered bacteria comprise a gene cassette encoding Indoleamine 2, 3 dioxygenase (EC 1.13.11.52; producing N-formyl kynurenine from tryptophan) and Kynurenine formamidase (EC3.5.1.9) producing kynurenine from n-formylkynurenine). In some embodiments, the enzymes are bacterially derived, e.g., as described in Vujkovi-Cvijin et al. 2013.

The genetically engineered bacteria may comprise any suitable gene for producing kynurenine. In some embodiments, the gene for producing kynurenine is modified and/or mutated, e.g., to enhance stability, increase kynurenine production, and/or increase anti-inflammatory potency under inducing conditions. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing kynurenine under inducing conditions, e.g., under a condition(s) associated with inflammation. In some embodiments, the genetically engineered bacteria are capable of producing kynurenine in low-oxygen conditions, in the presence of certain molecules or metabolites, in the presence of molecules or metabolites associated with inflammation or an inflammatory response, or in the presence of some other metabolite that may or may not be present in the gut, such as arabinose.

In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. The genetically engineered bacteria may comprise any suitable gene for producing kynurenic acid. In some embodiments, the gene for producing kynurenic acid is modified and/or mutated, e.g., to enhance stability, increase kynurenic acid production, and/or increase anti-inflammatory potency under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with inflammation or an inflammatory response, or in the presence of some other metabolite that may or may not be present in the gut, such as arabinose.

In some embodiments, the genetically engineered bacteria comprise one or more gene(s) or gene cassette(s) for the consumption of tryptophan and production of kynurenine, which are bacterially derived. In some embodiments, the enzymes for TRP to KYN conversion are derived from one or more of *Pseudomonas, Xanthomonas, Burkholderia, Stenotrophomonas, Shewanella*, and *Bacillus*, and/or members of the families Rhodobacteraceae, Micrococcaceae, and Halomonadaceae, In some embodiments the enzymes are derived from the species listed in table S7 of Vujkovic-Cvijin et al. (Dysbiosis of the gut microbiota is associated with HIV disease progression and tryptophan catabolism Sci Transl Med. 2013 Jul. 10; 5(193): 193ra91), the contents of which is herein incorporated by reference in its entirety.

In some embodiments, the one or more genes for producing kynurenine are modified and/or mutated, e.g., to enhance stability, increase kynurenine production, and/or increase anti-inflammatory potency under inducing conditions. In some embodiments, the engineered bacteria have enhanced uptake or import of tryptophan, e.g., comprise a transporter or other mechanism for increasing the uptake of tryptophan into the bacterial cell. In some embodiments, the genetically engineered bacteria are capable of producing kynurenine under inducing conditions, e.g., under a condition(s) associated with inflammation. In some embodiments, the genetically engineered bacteria are capable of producing kynurenine in low-oxygen conditions, in the presence of certain molecules or metabolites, in the presence of molecules or metabolites associated with inflammation or an inflammatory response, or in the presence of some other metabolite that may or may not be present in the gut, such as arabinose. In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. In some embodiments, In some embodiments, the genetically engineered bacteria prevent the accumulation of post-kynurenine KP metabolites, e.g., neurotoxic metabolites, or diabetogenic metabolites. In some embodiments, the genetically engineered bacteria encode Kynureninase from *Pseudomonas fluorescens*.

In some embodiments, the genetically engineered bacteria comprising one or more gene(s) or gene cassette(s) can alter the TRP:KYN ratio, e.g. in the circulation. In some embodiments the TRP:KYN ratio is increased. In some embodiments, TRP:KYN ratio is decreased. In some embodiments, the genetically engineered bacteria the genetically engineered bacteria comprising one or more gene(s) or gene cassette(s) can alter the KYNA:QUIN ratio.

In some embodiments, the genetically engineered bacteria are capable of expressing any one or more of the described circuits in low-oxygen conditions, in the presence of disease or tissue specific molecules or metabolites, in the presence of molecules or metabolites associated with inflammation or an inflammatory response or immune suppression, or in the presence of some other metabolite that may or may not be present in the gut, such as arabinose. In some embodiments, any one or more of the described circuits are present on one or more plasmids (e.g., high copy or low copy) or are integrated into one or more sites in the bacterial chromosome. Also, in some embodiments, the genetically engineered bacteria are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, and (6) combinations of one or more of such additional circuits.

Increasing Tryptophan

Figure 39:
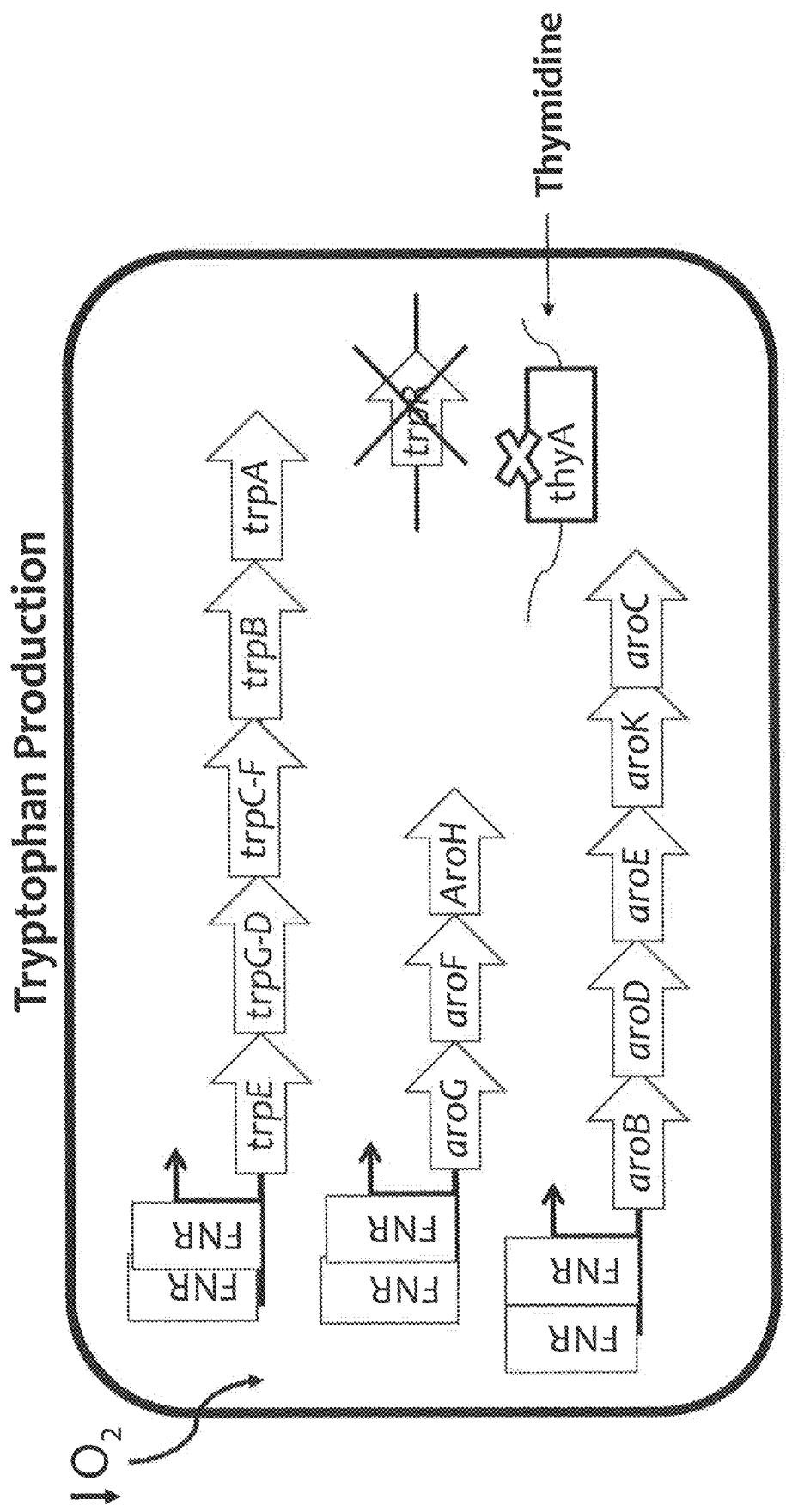
FIG. 39 shows a schematic depicting an exemplary Tryptophan circuit. Tryptophan is produced from the Chorismate precursor through expression of the trpE, trpG-D (also referred to as trpD), trpC-F (also referred to as trpC), trpB and trpA genes. Optional knockout of the tryptophan Repressor trpR is also depicted. Optional production of the Chorismate precursor through expression of aroG/F/H and aroB, aroD, aroE, aroK and aroC genes is also shown. All of these genes are optionally expressed from an inducible promoter, e.g., a FNR-inducible promoter. The bacteria may also include an auxotrophy, e.g., deletion of thyA (Δ thyA; thymidine dependence). The bacteria may also include gene sequence(s) for yddG to express YddG to assist in the exportation of tryptophan. Non limiting example of a bacterial strain is listed.
Figure 40:
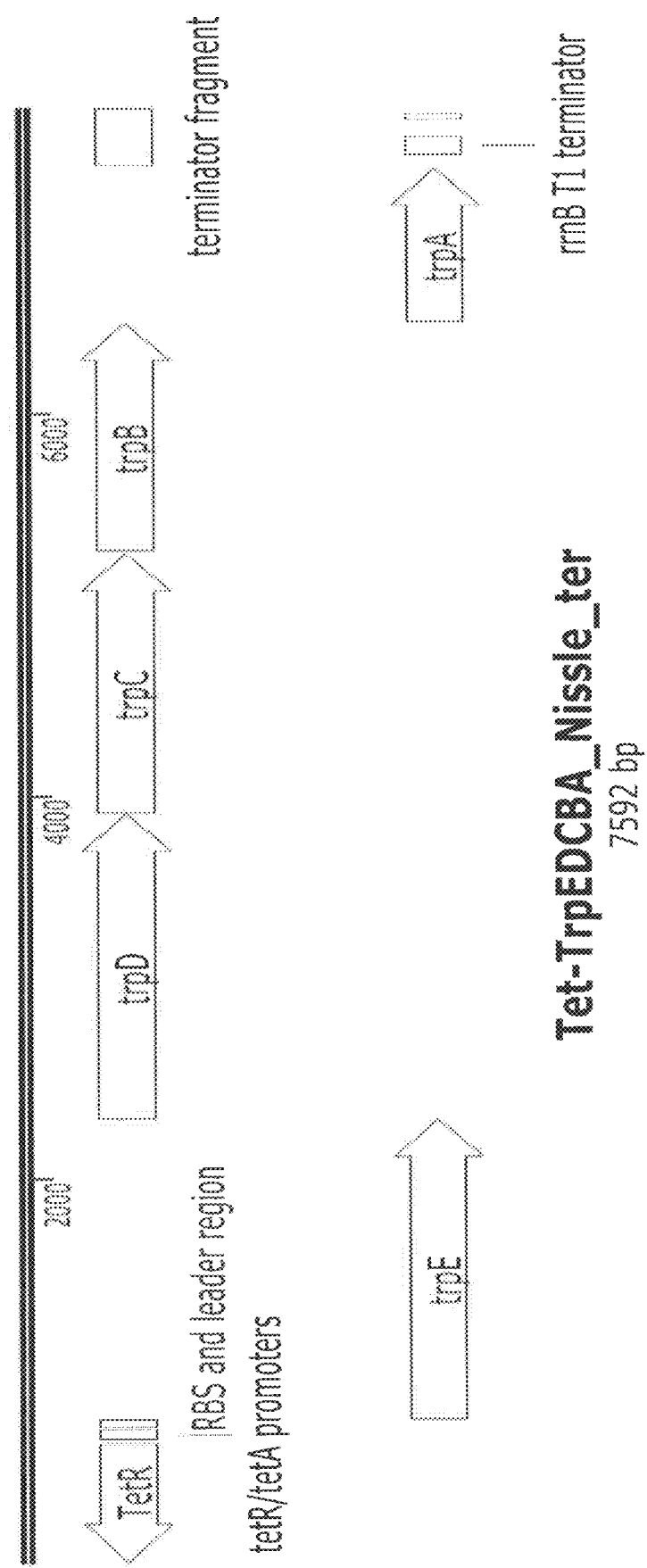
FIG. 40 depicts one embodiment of the disclosure in which the E. coli TRP synthesis enzymes are expressed from a construct under the control of a tetracycline inducible system.
Figure 45A:
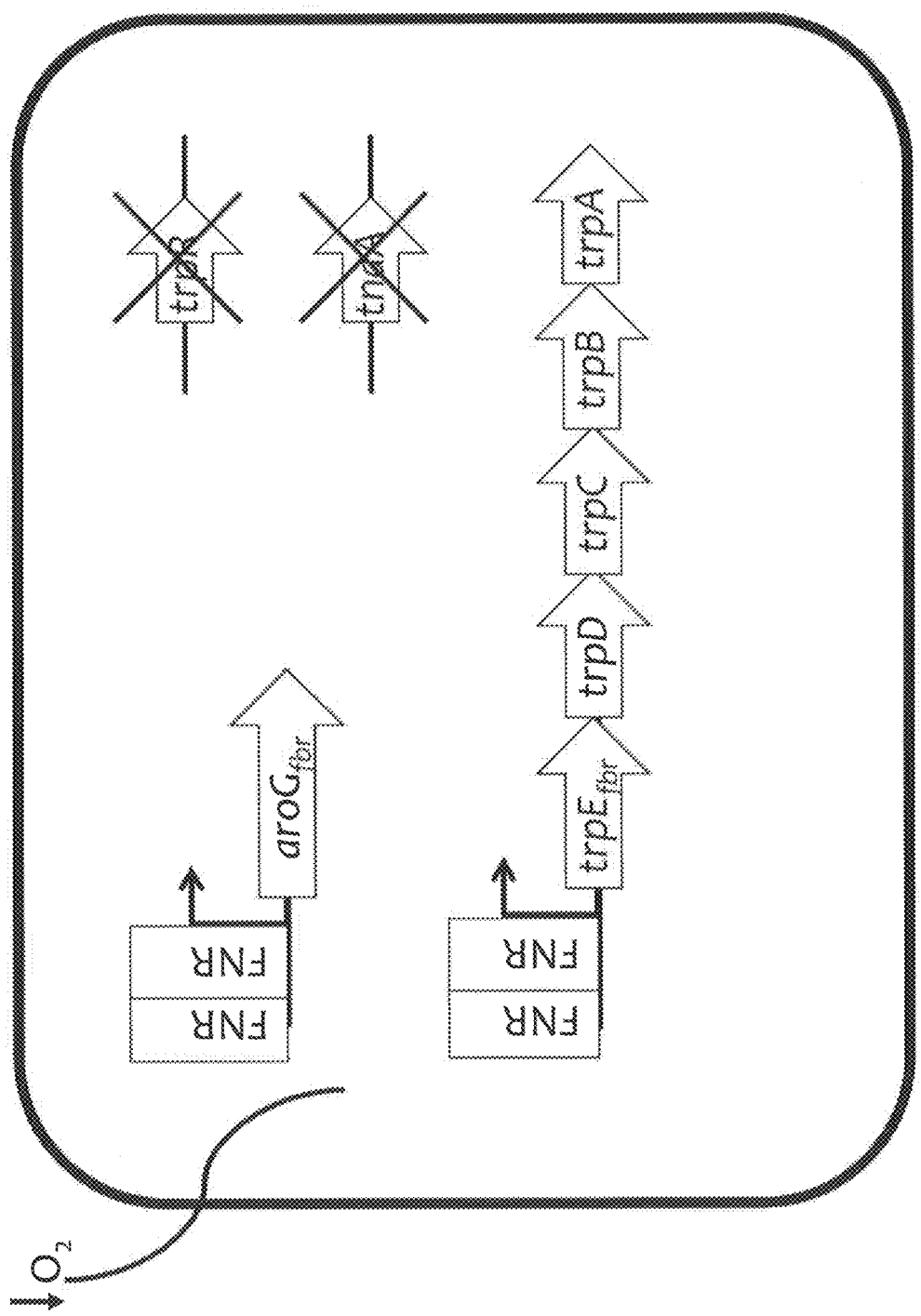
FIG. 45A, FIG. 45B, FIG. 45C, FIG. 45D, and FIG. 45E depict schematics of exemplary embodiments of the disclosure, in which the genetically engineered bacteria comprise circuits for the production of tryptophan, tryptamine, indole acetic acid, and indole propionic acid. Any of the gene(s), gene sequence(s) and/or gene circuit(s) or cassette(s) are optionally expressed from an inducible promoter. Exemplary inducible promoters which may control the expression of the gene(s), gene sequence(s) and/or gene circuit(s) or cassette(s) include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline. The bacteria may also include an auxotrophy, e.g., deletion of thyA (Δ thyA; thymidine dependence).
Figure 45B:
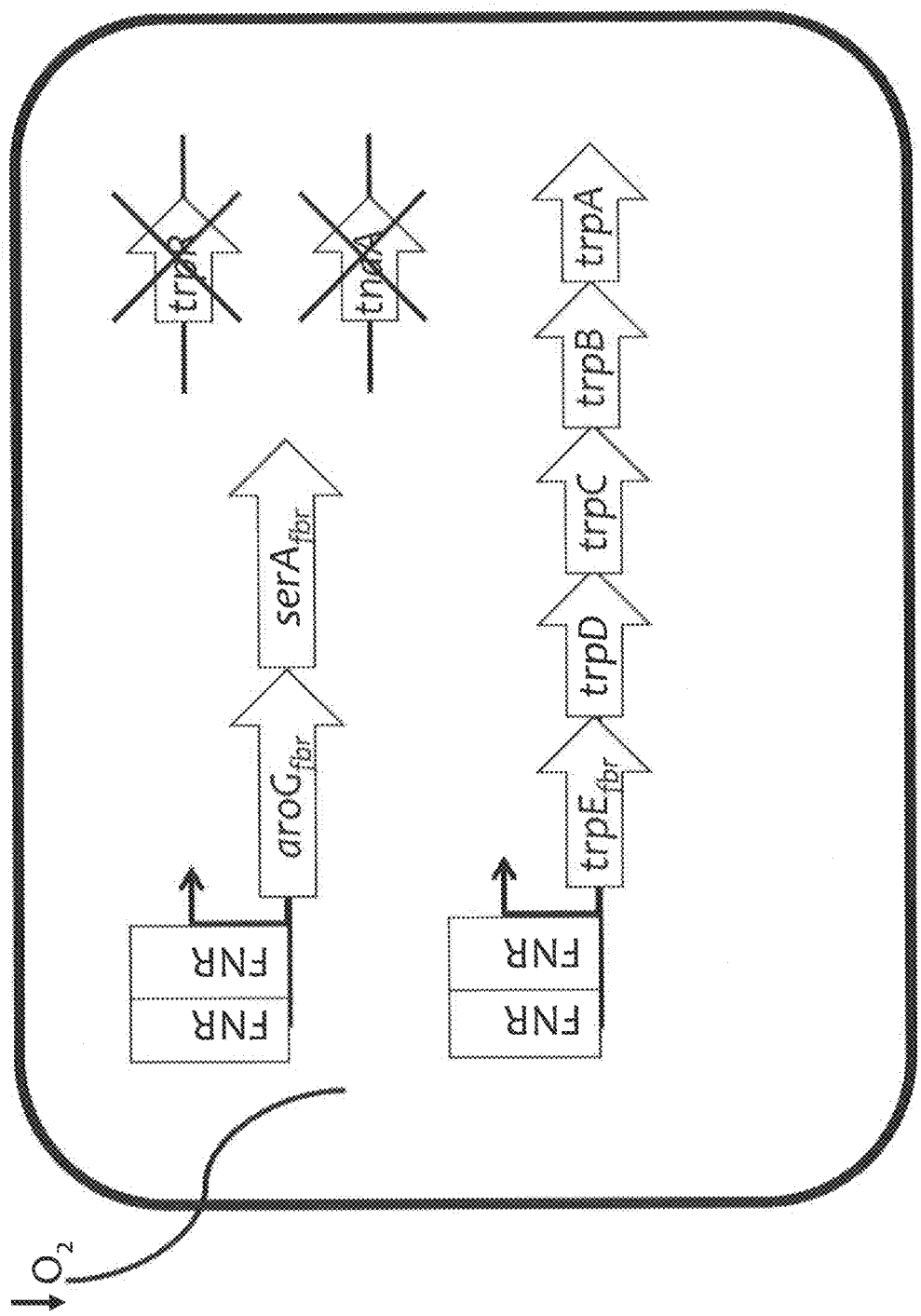

In some embodiments, the genetically engineered microorganisms of the present disclosure, are capable of producing tryptophan. Exemplary circuits for the production of tryptophan are shown in FIG. 39, FIG. 45A and FIG. 45B.

In some embodiments, the genetically engineered bacteria that produce tryptophan comprise one or more gene sequences encoding one or more enzymes of the tryptophan biosynthetic pathway. In some embodiments, the genetically engineered bacteria comprise a tryptophan operon. In some embodiments, the genetically engineered bacteria comprise the tryptophan operon of *E. coli*. (Yanofsky, R N A (2007), 13:1141-1154). In some embodiments, the genetically engineered bacteria comprise the tryptophan operon of *B. subtilis*. (Yanofsky, R N A (2007), 13:1141-1154). In some embodiments, the genetically engineered bacteria comprise sequence(s) encoding trypE, trypG-D, trypC-F, trypB, and trpA genes. In some embodiments, the genetically engineered bacteria comprise sequence(s) encoding trypE, trypG-D, trypC-F, trypB, and trpA genes from *E. Coli*. In some embodiments, the genetically engineered bacteria comprise sequence(s) encoding trypE, trypD, trypC, trypF, trypB, and trpA genes from *B. subtilis*.

Also, in any of these embodiments, the genetically engineered bacteria optionally comprise gene sequence(s) to produce the tryptophan precursor, chorismate. Thus, in some embodiments, the genetically engineered bacteria optionally comprise sequence(s) encoding aroG, aroF, aroH, aroB, aroD, aroE, aroK, and AroC. In some embodiments, the genetically engineered bacteria comprise one or more gene sequences encoding one or more enzymes of the tryptophan biosynthetic pathway and one or more gene sequences encoding one or more enzymes of the chorismate biosynthetic pathway. In some embodiments, the genetically engineered bacteria comprise sequence(s) encoding trypE, trypG-D, trypC-F, trypB, and trpA genes from *E. Coli* and sequence(s) encoding aroG, aroF, aroH, aroB, aroD, aroE, aroK, and AroC genes. In some embodiments, the genetically engineered bacteria comprise sequence(s) encoding trypE, trypD, trypC, trypF, trypB, and trpA genes from *B. subtilis* and sequence(s) encoding aroG, aroF, aroH, aroB, aroD, aroE, aroK, and AroC genes.

Figure 38:
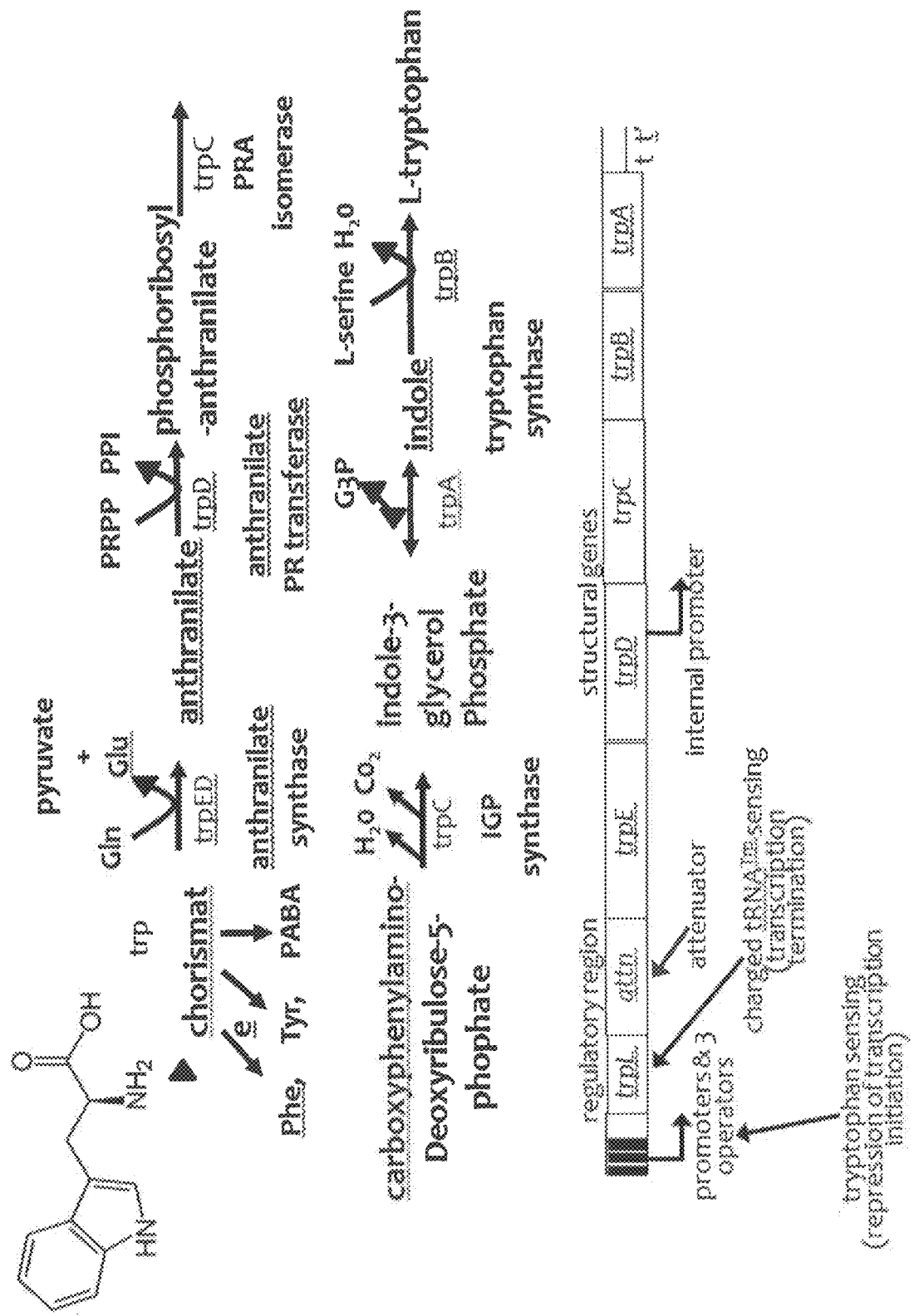
FIG. 38 depicts a schematic of the E. coli tryptophan synthesis pathway. In Escherichia coli, tryptophan is biosynthesized from chorismate, the principal common precursor of the aromatic amino acids tryptophan, tyrosine and phenylalanine, as well as the essential compounds tetrahydrofolate, ubiquinone-8, menaquinone-8 and enterobactin (enterochelin), as shown in the superpathway of chorismate metabolism. Five genes encode five enzymes that catalyze tryptopan biosynthesis from chorismate. The five genes trpE trpD trpC trpB trpA form a single transcription unit, the trp operon. A weak internal promoter also exists within the trpD structural gene that provides low, constitutive levels of mRNA.

In some embodiments, the genetically engineered bacteria comprise sequence(s) encoding either a wild type or a feedback resistant SerA gene (Table 10). *Escherichia coli* serA-encoded 3-phosphoglycerate (3PG) dehydrogenase catalyzes the first step of the major phosphorylated pathway of L-serine (Ser) biosynthesis. This step is an oxidation of 3PG to 3-phosphohydroxypyruvate (3PHP) with the concomitant reduction of NAD+ to NADH. As part of Tryptophan biosynthesis, *E. coli* uses one serine for each tryptophan produced. As a result, by expressing serA, tryptophan production is improved (see, e.g., FIG. 38).

In any of these embodiments, AroG and TrpE are optionally replaced with feedback resistant versions to improve tryptophan production (Table 10).

In any of these embodiments, the tryptophan repressor (trpR) optionally may be deleted, mutated, or modified so as to diminish or obliterate its repressor function.

In any of these embodiments the tnaA gene (encoding a tryptophanase converting Trp into indole) optionally may be deleted to prevent tryptophan catabolism along this pathway and to further increase levels of tryptophan produced (Table 10).

The inner membrane protein YddG of *Escherichia coli*, encoded by the yddG gene, is a homologue of the known amino acid exporters RhtA and YdeD. Studies have shown that YddG is capable of exporting aromatic amino acids, including tryptophan. Thus, YddG can function as a tryptophan exporter or a tryptophan secretion system (or tryptophan secretion protein). Other aromatic amino acid exporters are described in Doroshenko et al., FEMS Microbial Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

In some embodiments, the genetically engineered bacteria comprise a mechanism for metabolizing or degrading kyurenine, which, in some embodiments also results in the increased production of tryptophan. In some embodiments, the genetically engineered bacteria comprise sequence encoding the enzyme kynureninase. Kynureninase is produced to metabolize Kynurenine to Anthranilic acid in the cell. Schwarcz et al., Nature Reviews Neuroscience, 13, 465-477; 2012; Chen & Guillemin, 2009; 2; 1-19; Intl. J. Tryptophan Res. Exemplary kynureninase sequences are provided herein below in Table 11. In some embodiments, the engineered microbe has a mechanism for importing (transporting) Kynurenine from the local environment into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments, the genetically engineered bacteria comprise gene sequence(s) encoding enzymes of the tryptophan biosynthetic pathway and sequence encoding kynureninase. In some embodiments, the genetically engineered bacteria comprise a tryptophan operon, for example that of *E. coli*. or *B. subtilis*, and sequence encoding kynureninase. In some embodiments, the genetically engineered bacteria comprise sequence(s) encoding trypE, trypG-D, trypC-F, trypB, and trpA genes, for example, from *E. Coli* and sequence encoding kyureninase. In some embodiments, the genetically engineered bacteria comprise sequence(s) encoding trypE, trypD, trypC, trypF, trypB, and trpA genes, for example from *B. subtilis* and sequence encoding kyureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, for example, sequence(s) encoding aroG, aroF, aroH, aroB, aroD, aroE, aroK, and AroC. Thus, in some embodiments, the genetically engineered bacteria comprise sequence(s) encoding trypE, trypG-D, trypC-F, trypB, and trpA genes from *E. Coli*, sequence(s) encoding aroG, aroF, aroH, aroB, aroD, aroE, aroK, and AroC genes, and sequence encoding kyureninase. In some embodiments, the genetically engineered bacteria comprise sequence(s) encoding trypE, trypD, trypC, trypF, trypB, and trpA genes from *B. subtilis*, sequence(s) encoding aroG, aroF, aroH, aroB, aroD, aroE, aroK, and AroC genes, and sequence encoding kyureninase.

In some embodiments, the genetically engineered bacteria may optionally have a deletion or mutation in the endogenous trpE, rendering trpE non-functional. Accordingly, in one embodiment, the genetically engineered bacteria may comprise one or more gene(s) or gene cassette(s) encoding trpD, trpC, trpA, and trpD and kynureninase (see, e.g. FIG. 18). This deletion may prevent tryptophan production through the endogenous chorismate pathway, and may increase the production of tryptophan from kynurenine through kynureninase.

In some embodiments, the genetically engineered bacteria comprise sequence(s) encoding either a wild type or a feedback resistant SerA gene (Table 10).

In any of these embodiments, AroG and TrpE are optionally replaced with feedback resistant versions to improve tryptophan production (Table 10).

In any of these embodiments, the tryptophan repressor (trpR) optionally may be deleted, mutated, or modified so as to diminish or obliterate its repressor function.

In any of these embodiments the tnaA gene (encoding a tryptophanase converting Trp into indole) optionally may be deleted to prevent tryptophan catabolism along this pathway and to further increase levels of tryptophan produced (Table 10).

In any of these embodiments, the genetically engineered bacterium may further comprise gene sequence for exporting or secreting tryptophan from the cell. Thus, in some embodiments, the engineered bacteria further comprise gene sequence(s) encoding YddG. In some embodiments, the engineered bacteria can over-express YddG, an aromatic amino acid exporter. In some embodiments, the engineered bacteria optionally comprise one or more copies of yddG gene. In any of these embodiments, the genetically engineered bacterium may further comprise gene sequence for importing or transporting kynurenine into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments, the genetically engineered bacterium or genetically engineered microorganism comprises one or more genes for producing tryptophan and/or kynureninase, under the control of a promoter that is activated by low-oxygen conditions, by inflammatory conditions, such as any of the promoters activated by said conditions and described herein. In some embodiments, the genetically engineered bacteria expresses one or more genes for producing tryptophan and/or kynureninase, under the control of a cancer-specific promoter, a tissue-specific promoter, or a constitutive promoter, such as any of the promoters described herein. Table 9 lists exemplary tryptophan synthesis cassettes encoded by the genetically engineered bacteria of the disclosure.

TABLE 9

Tryptophan Synthesis Cassette Sequences

| Description | Sequence |
| --- | --- |
| Tet-regulated Tryptophan operon SEQ ID NO: 71 | taagacccactttcacatttaagttgtttttctaatccgcatatgatcaattcaaggccgaataagaaggctggctct gcacccttggtgatcaaataattcgatagcttgtcgtaataggcggcatactatcagtagtaggtgtttcccttt tctttagcgacttgatgctcttgatcttccaatacgcaacctaaagtaaaatgccccacagcgctgagtgcatata atgcattctctagtgaaaaaccttgttggcataaaaaggctaattgattttcgagagtttcatactgtttttctgtagg ccgtgtacctaaatgtacttttgctccatcgcgatgacttagtaaagcacatctaaaacttttagcgttattacgtaa aaaatcttgccagctttcccccttctaaagggcaaaagtgagtatggtgcctatctaacatctcaatggctaaggcg tcgagcaaagcccgcttatttttttacatgccaatacaatgtaggctgctctacacctagcttctgggcgagtttacg ggttgttaaaccttcgattccgaccctcattaagcagctctaatgcgctgttaatcactttacttttatctaatctagaca tcattaattcctaatttttgttgacactctatcattgatagagttattttaccactccctatcagtgatagagaaaagtg aactctagaaataattttgtttaactttaagaaggagatatacatatgcaaacacaaaaaccgactctcgaactgct aacctgcgaaggcgcttatcgcgacaacccgactgcgcttttcaccagttgtgtggggatcgtccggcaacg ctgctgctggaatccgcagatatcgacagcaaagatgatttaaaaagcctgctgctggtagacagtgcgctgc gcattacagcattaagtgacactgtcacaatccaggcgctttccggcaatggagaagccctgttgacactactg gataacgccttgcctgcgggtgtggaaaatgaacaatcaccaaactgccgcgtactgcgcttcccgcctgtca gtccactgctggatgaagacgcccgcttatgctcccttcggttttgacgcttccgcttattacagaatctgttga atgtaccgaaggaagaacgagaagcaatgttcttcggcggcctgttctcttatgaccttgtggcgggatttgaaa atttaccgcaactgtcagcggaaaatagctgccctgatttctgtttttatctcgctgaaacgctgatggtgattgac catcagaaaaaaagcactcgtattcaggccagcctgttgctccgaatgaagaagaaaaacaacgtctcactgc tcgcctgaacgaactacgtcagcaactgaccgaagccgcgccgccgctgccggtggtttccgtgccgcatat gcgttgtgaatgtaaccagagcgatgaagagttcggtggtgtagtgcgtttgttgcaaaaagcgattcgcgccg gagaaattttccaggtggtgccatctcgccgtttctctctgccctgcccgtcaccgctggcagcctattacgtgct gaaaaagagtaatcccagcccgtacatgttttttatgcaggataatgatttcaccctgtttggcgcgtcgccggaa agttcgctcaagtatgacgccaccagccgccagattgagatttacccgattgccggaacacgtccacgcggtc gtcgtgccgatggttcgctggacagagacctcgacagccgcatcgaactggagatgcgtaccgatcataaag agctttctgaacatctgatgctggtggatctcgcccgtaatgacctggcacgcatttgcacacccggcagccgc tacgtcgccgatctcaccaaagttgaccgttactcttacgtgatgcacctagtctcccgcgttgttggtgagctgc gccacgatctcgacgccctgcacgcttaccgcgcctgtatgaatatggggacgttaagcggtgcaccgaaagt acgcgctatgcagttaattgccgaagcagaaggtcgtcgacgcggcagctacggcggcgcggtaggttatttt accgcgcatggcgatctcgacacctgcattgtgatccgctcggcgctggtggaaaacggtatcgccaccgtgc aagccggtgctggcgtagtccttgattctgttccgcagtcggaagccgacgaaactcgtaataaagcccgcgc tgtactgcgcgctattgccaccgcgcatcatgcacaggagacgttctaatggctgacattctgctgctcgataat atcgactcttttacgtacaacctggcagatcagttgcgcagcaatggtcataacgtggtgatttaccgcaaccata ttccggcgcagaccttaattgaacgcctggcgacgatgagcaatccggtgctgatgctttctcctggccccggt gtgccgagcgaagccggttgtatgccggaactcctcacccgcttgcgtggcaagctgccaattattggcattg cctcggacatcaggcgattgtcgaagcttacgggggctatgtcggtcaggcgggcgaaattcttcacggtaaa gcgtcagcattgaacatgacggtcaggcgatgtttgccggattaacaaacccgctgccagtggcgcgttatc actcgctggttggcagtaacattccggccggtttaaccatcaacgcccattttaatggcatggtgatggcggtgc gtcacgatgcagatcgcgtttgtggattccagttccatccggaatccattcttactacccagggcgctcgcctgct ggaacaaacgctggcctgggcgcagcagaaactagagccaaccaacgctgcaaccgattctggaaaaa ctgtatcaggcacagacgcttagccaacaagaaagccaccagctgttttcagcggtggtacgtggcgagctga agccggaacaactggcggcggcgctggtgagcatgaaaattcgcggtgaacacccgaacgagatcgccgg ggcagcaaccgcgctactggaaaacgccgcgccattcccgcgcccggattatctgtttgccgatatcgtcggt actggcggtgacggcgcaacagcatcaatatttctaccgccagtgcgtttgtcgccgcggcctgcgggctga aagtggcgaaacacggcaaccgtagcgtctccagtaaatccggctcgtcggatctgctggcggcgttcggtat taatcttgatatgaacgccgataaatcgcgccaggcgctggatgagttaggcgtctgtttcctcttgcgccgaa gtatcacaccggattccgccatgcgatgccggttcgccagcaactgaaaacccgcactctgttcaacgtgctg ggaccattgattaacccggcgcatccgccgctggcgctaattggtgtttatagtccggaactggtgctgccgatt gccgaaaccttgcgcgtgctggggtatcaacgcgcagcggtgcacagcgcgggatggatgaagtttc attacacgcgccgacaatcgttgccgaactacatgacggcgaaattaagagctatcaattgaccgctgaagatt ttggcctgacaccctaccaccaggagcaattggcaggcggaacaccggaagaaaaccgtgacattttaacac gcttgttacaaggtaaaggcgacgccgcccatgaagcagccgtcgcggcgaatgtcgccatgttaatgcgcct gcatggccatgaagatctgcaagccaatgcgcaaaccgttcttgaggtactgcgcagtggttccgcttacgaca gagtcaccgcactggcggcacgagggtaaatgatgcaaaccgttttagcgaaaatcgtcgcagacaaggcg |

TABLE 9-continued

Tryptophan Synthesis Cassette Sequences

| Description | Sequence |
|---|---|
| | atttgggtagaaacccgcaaagagcagcaaccgctggccagttttcagaatgaggttcagccgagcacgcga<br>cattttatgatgcacttcagggcgcacgcacggcgtttattctggagtgtaaaaaagcgtcgccgtcaaaaggc<br>gtgatccgtgatgatttcgatccggcacgcattgccgccatttataaacattacgcttcggcaatttcagtgctgac<br>tgatgagaaatattttcagggagctttgatttcctccccatcgtcagccaaatcgccccgcagccgattttatgta<br>aagacttcattatcgatccttaccagatctatctggcgcgctattaccaggccgatgcctgcttattaatgcttcag<br>tactggatgacgaacaatatcgccagcttgcagccgtcgcccacagtctggagatgggtgtgctgaccgaagt<br>cagtaatgaagaggaactggagcgcgccattgcattgggggcaaaggtcgttggcatcaacaaccgcgatct<br>gcgcgatttgtcgattgatctcaaccgtacccgcgagcttgcgccgaaactggggcacaacgtgacggtaatc<br>agcgaatccggcatcaatacttacgctcaggtgcgcgagttaagccacttcgctaacggctttctgattggttcg<br>gcgttgatggcccatgacgatttgaacgccgccgtgcgtcgggtgttgctgggtgagaataaagtatgtggcct<br>gacacgtgggcaagatgctaaagcagcttatgacgcgggcgcgatttacggtgggttgattttgttgcgacat<br>caccgcgttgcgtcaacgttgaacaggcgcaggaagtgatggctgcagcaccgttgcagtatgttggcgtgtt<br>ccgcaatcacgatattgccgatgtggcggacaaagctaaggtgttatcgctggcggcagtgcaactgcatggt<br>aatgaagatcagctgtatatcgacaatctgcgtgaggctctgccagcacacgtcgccatctggaaggctttaag<br>tgtcggtgaaactcttcccgcgcgcgattttcagcacatcgataaatatgtattcgacaacggtcagggcggga<br>gcggacaacgtttcgactggtcactattaaatggtcaatcgcttggcaacgttctgctggcggggggcttaggc<br>gcagataactgcgtggaagcggcacaaaccgctgcgccggtcgttgattttaattctgctgtagagtcgcaac<br>cgggtatcaaagacgcacgtcttttggcctcggttttccagacgctgcgcgcatattaaggaaaggaacaatga<br>caacattacttaaccccctattttggtgagtttggcggcatgtacgtgccacaaatcctgatgcctgctctgcgcca<br>gctggaagaagcttttgtcagcgcgcaaaaagatcctgaatttcaggctcagttcaacgacctgctgaaaaact<br>atgccgggcgtccaaccgcgctgaccaaatgccagaacattacagccgggacgaacaccacgctgtatctga<br>agcgcgaagatttgctgcacggcggcgcgcataaaactaaccaggtgctcggtcaggctttactggcgaagc<br>ggatgggtaaaactgaaattattgccgaaaccggtgccggtcagcatggcgtggcgtcggcccttgccagcg<br>ccctgctcggcctgaaatgccgaatttatatgggtgccaaagacgttgaacgccagtcgcccaacgttttccgg<br>atgcgcttaatgggtgcggaagtgatcccggtacatagcggttccgcgaccctgaaagatgcctgtaatgagg<br>cgctacgcgactggtccggcagttatgaaaccgcgcactatatgctgggtaccgcagctggcccgcatcctta<br>cccgaccattgtgcgtgagtttcagcggatgattggcgaagaaacgaaagcgcagattctggaaagagaagg<br>tcgcctgccggatgccgttatcgcctgtgttggcggtggttcgaatgccatcggtatgtttgcagatttcatcaac<br>gaaaccgacgtcggcctgattggtgtggagcctggcggccacggtatcgaaactggcgagcacggccgcacc<br>gttaaaacatggtcgcgtgggcatctatttcggtatgaaagcgccgatgatgcaaaccgaagacgggcaaatt<br>gaagagtcttactccatttctgccgggctggatttcccgtccgtcggcccgcaacatgcgtatctcaacagcact<br>ggacgcgctgattacgtgtctattaccgacgatgaagccctggaagcctttaaaacgctttgcctgcatgaagg<br>gatcatcccggcgctggaatcctcccacgccctggcccatgcgctgaaaatgatgcgcgaaaatccggaaaa<br>agagcagctactggtggttaaccttccggtcgcggcgataaagacatcttcaccgttcacgatatttttgaaagc<br>acgaggggaaatctgatggaacgctacgaatctctgtttgcccagttgaaggagcgcaaagaaggcgcattc<br>gttcctttcgtcaccctcggtgatccgggcattgagcagtcgttgaaaattatcgatacgctaattgaagccggtg<br>ctgacgcgctggagttaggcatccccttctccgacccactggcggatggcccgacgattcaaaacgccacact<br>gcgtgcttttgcggcgggagtaaccccggcagtgcttttgagatgctggcactcattcgccagagacaccccg<br>accattcccatcggccttttgatgtatgccaacctggtgtttaacaaaggcattgatgagtttttatgccgagtgcga<br>gaaagtcggcgtcgattcggtgctggttgccgatgtgcccgtgaagagtccgcgcccttccgccaggccgc<br>gttgcgtcataatgtcgcacctatctttatttgcccgccgaatgccgacgatgatttgctgcgccagatagcctctt<br>acggtcgtggttacacctattgctgtcgcgagcgggcggacggcgcagaaaaccgcgcgcgttaccc<br>tcaatcatctggttgcgaagctgaaagagtacaacgctgcgcctccattgcagggatttggtatttccgcccgg<br>atcaggtaaaagccgcgattgatgcaggagctgcgggcgcgatttctggttcggccatcgttaaaatcatcgag<br>caacatattaatgagccagagaaaatgctggcggcactgaaagcttttgtacaaccgatgaaagcggcgacgc<br>gcagttaatacgcatggcatggatgaCCGATGGTAGTGTGGGGTCTCCCCATGCG<br>AGAGTAGGGAACTGCCAGGCATCAAATAAAACGAAAGGCTCAGT<br>CGAAAGACTGGGCCTTTCGTTTTATCTGTTGTTTGTCGGTGAACGC<br>TCTCCTGAGTAGGACAAATCCGCCGGGAGCGGATTTGAACGTTGC<br>GAAGCAACGGCCCGGAGGGTGGCGGGCAGGACGCCCGCCATAAA<br>CTGCCAGGCATCAAATTAAGCAGAAGGCCATCCTGACGGATGGCC<br>TTTTTGCGTGGCCAGTGCCAAGCTTGCATGCGTGC |
| Tet repressor<br>SEQ ID<br>NO: 72 | taagacccactttcacatttaagttgttttctaatccgcatatgatcaattcaaggccgaataagaaggctggctct<br>gcaccttggtgatcaaataattcgatagcttgtcgtaataatgcggcatactatcagtagtaggtgtttccctttct<br>tctttagcgacttgatgctcttgatcttccaatacgcaacctaaagtaaaatgccccacagcgctgagtgcatata<br>atgcattctctagtgaaaaaccttgttggcataaaaaggctaattgattttcgagagtttcatactgtttttctgtagg<br>ccgtgtacctaaatgtacttttgctccatcgcgatgacttagtaaagcacatctaaaacttttagcgttattacgtaa<br>aaaatcttgccagctttcccctttctaaagggcaaaagtgagtatggtggcctatctaacatctcaagtgctaaggcg<br>tcgagcaaagcccgcttattttttacatgccaatacaatgtaggctgctctacacctagcttctgggcgagtttacg<br>ggttgttaaaaccttcgattccgacctcattaagcagctctaatgcgctgttaatcacttttacttttatctaatctagacat |
| tetR/tetA<br>promoters and<br>RBS and<br>leader region<br>SEQ ID NO<br>73: | cattaattcctaattttttgttgacactctatcattgatagagttattttaccactccctatcagtgatagagaaaagtga<br>actctagaaataattttgtttaactttaagaaggagatatacat |
| trpE<br>SEQ ID NO:<br>74 | atgcaaacacaaaaaccgactctcgaactgctaacctgcgaaggcgcttatcgcgacaacccgactgcgctttt<br>tcaccagttgtgtgggatcgtccggcaacgctgctggaatccgcagatatcgacagcaaagatgatttaa<br>aaagcctgctgctggtagacagtgcgctgcgcattacagcattaagtgacactgtcacaatccaggcgctttcc<br>ggcaatggagaagccctgttgacactactgctgataacgccttgcctgcgggtgtggaaatgaacaatcaccaa<br>actgccgcgtactgcgcttcccgcctgtcagtccactgctggatgaagacgcccgcttatgctcccttcggtttt<br>tgacgctttccgcttattacagaatctgttgaatgtaccgaaggaagaacgagaagcaatgttcttcggcggcct<br>gttctcttatgaccttgtggcgggatttgaaaatttaccgcaactgtcagcggaaaatagctgccctgatttctgttt |

TABLE 9-continued

Tryptophan Synthesis Cassette Sequences

| Description | Sequence |
|---|---|
| | ttatctcgctgaaacgctgatggtgattgaccatcagaaaaaaagcactcgtattcaggccagcctgtttgctcc<br>gaatgaagaagaaaaacaacgtctcactgctcgcctgaacgaactacgtcagcaactgaccgaagccgcgc<br>cgccgctgccggtggtttccgtgccgcatatgcgttgtgaatgtaaccagagcgatgaagagttcggtggtgta<br>gtgcgtttgttgcaaaaagcgattcgcgccggagaaattttccaggtggtgccatctcgccgtttctctctgccct<br>gcccgtcaccgctggcagcctattacgtgctgaaaaagagtaatcccagcccgtacatgttttttatgcaggata<br>atgatttcaccctgtttggcgcgtcgccggaaagttcgctcaagtatgacgccaccagccgccagattgagattt<br>acccgattgccggaacacgtccacgcggtcgtcgtgccgatggttcgctggacagagacctcgacagccgc<br>atcgaactggagatgcgtaccgatcataaagagctttctgaacatctgatgctggtggatctcgcccgtaatgac<br>ctggcacgcatttgcacacccggcagccgctacgtcgccgatctcaccaaagttgaccgttactcttacgtgat<br>gcacctagtctcccgcgttgttggtgagctgcgccacgatctcgacgccctgcacgcttaccgcgcctgtatga<br>atatggggacgttaagcggtgcaccgaaagtacgcgctatgcagttaattgccgaagcagaaggtcgtcgac<br>gcggcagctacggcggcgcggtaggttattttaccgcgcatggcgatctcgacacctgcattgtgatccgctc<br>ggcgctggtggaaaacggtatcgccaccgtgcaagccggtgctggcgtagtccttgattctgttccgcagtcg<br>gaagccgacgaaactcgtaataaagcccgcgctgtactgcgcgctattgccaccgcgcatcatgcacaggag<br>acgttcta |
| TrpE<br>SEQ ID NO:<br>75 | MQTQKPTLELLTCEGAYRDNPTALFHQLCGDRPATLLLESADIDSKD<br>DLKSLLLVDSALRITALSDTVTIQALSGNGEALLTLLDNALPAGVENE<br>QSPNCRVLRFPPVSPLLDEDARLCSLSVFDAFRLLQNLLNVPKEEREA<br>MFFGGLFSYDLVAGFENLPQLSAENSCPDFCFYLAETLMVIDHQKKST<br>RIQASLFAPNEEEKQRLTARLNELRQQLTEAAPPLPVVSVPHMRCECN<br>QSDEEFGGVVRLLQKAIRAGEIFQVVPSRRFSLPCPSPLAAYYVLKKS<br>NPSPYMFFMQNDNDFTLFGASPESSLKYDATSRQIEIYPIAGTRPRGRRA<br>DGSLDRDLDSRIELEMRTDHKELSEHLMLVDLARNDLARICTPGSRY<br>VADLTKVDRYSYVMHLVSRVVGELRHDLDALHAYRACMNMGTLSG<br>APKVRAMQLIAEAEGRRRGSYGGAVGYFTAHGDLDTCIVIRSALVEN<br>GIATVQAGAGVVLDSVPQSEADETRNKARAVLRAIATAHHAQETF |
| trpD<br>SEQ ID NO:<br>76 | atggctgacattctgctgctcgataatatcgactcttttacgtacaacctggcagatcagttgcgcagcaatggtc<br>ataacgtggtgatttaccgcaaccatattccggcgcagaccttaattgaacgcctggcgacgatgagcaatccg<br>gtgctgatgctttctcctggccccggtgtgccgagcgaagccggttgtatgccggaactcctcacccgcttgcg<br>tggcaagctgccaattattggcatttgcctcggacatcaggcgattgtcgaagcttacgggggctatgtcggtca<br>ggcgggcgaaattcttcacggtaaagcgtcgagcattgaacatgacggtcaggcgatgtttgccggattaaca<br>aaccgcctgccagtggcgcgttatcactcgctggttggcagtaacattccggccggttaacctcaacgccca<br>ttttaatggcatggtgatggcggtcgtcacgatgcagatcgcgtttgtggattccagttccatccggaatccatt<br>cttactacccaggcgctcgcctgctggaacaaacgctggcctgggcgcagcagaaactagagccaaccaa<br>cacgctgcaaccgattctggaaaaactgtatcaggcacagacgcttagccaacaagaaagccaccagctgttt<br>tcagcggtggtacgtggcgagctgaagccggaacaactgcccgagcagatggtggagcatgaaaattcgcgg<br>tgaacacccgaacgagatcgccggggcagcaaccgcgctactggaaaacgccgcgccattcccgcgcccg<br>gattatctgtttgccgatatcgtcggtactggcggtgacggcagcaacagcatcaatatttctaccgccagtgcg<br>tttgtcgccgcggcctgcgggctgaaagtggcgaaacacggcaaccgtagcgtctccagtaaatccggctcg<br>tccggatctgcggcgcgttcggtattaatcttgatatgaacgccgataaatcgcgccaggcgctggatgagtta<br>ggcgtctgtttcctcttttgccgaagtatcacaccggattccgccatgcgatgccggttcgccagcaactgaa<br>aacccgcactctgttcaacgtgctgggaccattgattaacccggcgcatccgccgctggcgctaattggtgttta<br>tagtccggaactggtgctgccgattgccgaaaccttgcgcgtgctggggtatcaacgcgcggcagtggtgca<br>cagccgcgggatggatgaagtttcattacgaccgccgacaatcgttgccgaactacatgacggcggaattaag<br>agctatcaattgaccgctgaagattttggcctgacaccctaccaccaggagcaattggcaggcggaacaccgg<br>aagaaaaccgtgacatttaacacgcttgttacaaggtaaaggcgacgccgcccatgaagcagccgtcgcgg<br>cgaatgtcgccatgttaatgcgcctgcatggccatgaagatctgcaagccaatgcgcaaaccgttcttgaggta<br>ctgcgcagtggttccgcttacgacagagtcaccgcactggcggcacgagggtaa |
| TrpD<br>SEQ ID NO:<br>77 | MADILLLDNIDSFTYNLADQLRSNGHNVVIYRNHIPAQTLIERLATMS<br>NPVLMLSPGPGVPSEAGCMPELLTRLRGKLPIIGICLGHQAIVEAYGG<br>YVVGQAGEILHGKASSIEHDGQAMFAGLTNPLPVARYHSLVGSNIPAG<br>LTINAHFNGMVMAVRHDADRVCGFQFHPESILTTQGARLLEQTLAW<br>AQQKLEPTNTLQPILEKLYQAQTLSQQESHQLFSAVVRGELKPEQLAA<br>ALVSMKIRGEHPNEIAGAATALLENAAPFPRPDYLFADIVGTGGDGSN<br>SINISTASAFVAAACGLKVAKHGNRSVSSKSGSSDLLAAFGINLDMNA<br>DKSRQALDELGVCFLFAPKYHTGFRHAMPVRQQLKTRTLFNVLGPLI<br>NPAHPPLALIGVYSPELVLPIAETLRVLGYQRAAVVHSGGMDEVSLH<br>APTIVAELHDGEIKSYQLTAEDFGLTPYHQEQLAGGTPEENRDILTRLL<br>QGKGDAAHEAAVAANVAMLRLHGHEDLQANAQTVLEVLRSGSA<br>YDRVTALAARG |
| trpC<br>SEQ ID NO:<br>78 | atgcaaaccgttttagcgaaaatcgtcgcagacaaggcgatttgggtagaaacccgcaaagagcagcaaccg<br>ctggccagttttcagaatgaggttcagccgagcacgcgacatttttatgatgcacttcagggcgcacgcacggc<br>gtttattctggagtgtaaaaaagcgtcgccgtcaaaaggcgtgatccgtgatgatttcgatccggcacgcattgc<br>cgccatttataaacattacgcttcggcaatttcagtgctgactgatgagaaatattttcaggggagctttgatttcct<br>ccccatcgtcagccaaatcgccccgcagccgatttttgtaaagacttcattatcgatcctttaccagatctatctg<br>gcgcgctattaccaggccgatgcctgcttattaatgctttcagtactggatgacgaacaatatcgccagcttgca<br>gccgtcgcccacagtctggagatgggtgtgctgaccgaagtcagtcagtaagaggaactggagcggcatt<br>gcattgggggcaaaggtcgttggcatcaacaaccgcgatctgcgcgatttgtcgattgatctcaaccgtacccg<br>cgagcttgcgccgaaactggggcacaacgtgacggtaatcagcgaatccggcatcaatacttacgctcaggt<br>gcgcgagttaagccacttcgctaacggctttctgattggttcggcgttgatggcccatgacgatttgaacgccgc<br>cgtgcgtcgggtgttgctgggtgagaataaagtatgtggcctgacacgtgggcaagatgctaaagcagcttat<br>gacgcgggcgcgatttacggtggggttgattttgttgcgacatcaccgcgttgcgtcaacgttgaacaggcgca |

TABLE 9-continued

Tryptophan Synthesis Cassette Sequences

| Description | Sequence |
|---|---|
| | ggaagtgatggctgcagcaccgttgcagtatgttggcgtgttccgcaatcacgatattgccgatgtggcggaca<br>aagctaaggtgttatcgctggcggcagtgcaactgcatggtaatgaagatcagctgtatatcgacaatctgcgt<br>gaggctctgccagcacacgtcgccatctggaaggctttaagtgtcggtgaaactcttcccgcgcgcgatttttca<br>gcacatcgataaatatgtattcgacaacggtcagggcgggagcggacaacgtttcgactggtcactattaaatg<br>gtcaatcgcttggcaacgttctgctggcgggggggcttaggcgcagataactgcgtggaagcggcacaaaccg<br>gctgcgccgggcttgattttaattctgctgtagagtcgcaaccgggtatcaaagacgcacgtcttttggcctcggt<br>tttccagacgctgcgcgcatattaa |
| TrpC<br>SEQ ID NO:<br>79 | MQTVLAKIVADKAIWVETRKEQQPLASFQNEVQPSTRHFYDALQGA<br>RTAFILECKKASPSKGVIRDDFDPARIAAIYKHYASAISVLTDEKYFQG<br>SFDFLPIVSQIAPQPILCKDFIIDPYQIYLARYYQADACLLMLSVLDDEQ<br>YRQLAAVAHSLEMGVLTEVSNEEELERAIALGAKVVGINNRDLRDLS<br>IDLNRTRELAPKLGHNVTVISESGINTYAQVRELSHFANGFLIGSALM<br>AHDDLNAAVRRVLLGENKVCGLTRGQDAKAAYDAGAIYGGLIFVAT<br>SPRCVNVEQAQEVMAAAPLQYVGVFRNHDIADVADKAKVLSLAAV<br>QLHGNEDQLYIDNLREALPAHVAIWKALSVGETLPARDFQHIDKYVF<br>DNGQGGSGQRFDWSLLNGQSLGNVLLAGGLGADNCVEAAQTGCAG<br>LDFNSAVESQPGIKDARLLASVFQTLRAY |
| trpB<br>SEQ ID NO:<br>80 | atgacaacattacttaacccctattttggtgagtttggcggcatgtacgtgccacaaatcctgatgcctgctctgcg<br>ccagctggaagaagcttttgtcagcgcgcaaaaagatcctgaatttcaggctcagttcaacgacctgctgaaaa<br>actatgccgggcgtccaaccgcgctgaccaaatgccagaacattacagccgggacgaacaccacgctgtatc<br>tgaagcgcgaagatttgctgcacggcggcgcgcataaaactaaccaggtgctcggtcaggctttactggcga<br>agcggatgggtaaaactgaaattattgccgaaaccggtgccggtcagcatggcgtggcgtcggcccttgcca<br>gcgccctgctcggcctgaaatgccgaatttatatgggtgccaaagacgttgaacgccagtcgcccaacgttttc<br>cggatgcgcttaatgggtgcggaagtgatcccggtacatagcggttccgcgaccctgaaagatgcctgtaatg<br>aggcgctacgcgactggtccggcagttatgaaaccgcgcactatatgctgggtaccgcagctggcccgcatc<br>cttacccgaccattgtgcgtgagtttcagcggatgattggcgaagaaacgaaagcgcagattctggaaagaga<br>aggtcgcctgccggatgccgttatcgcctgtgttggcggtggttcgaatgccatcggtatgtttgcagatttcatc<br>aacgaaaccgacgtcggcctgattggtgtggagcctggcggccacggtatcgaaactggcgagcacggcgc<br>accgttaaaacatggtcgcgtgggcatctatttcggtatgaaagcgccgatgatgcaaaccgaagacgggcaa<br>attgaagagtcttactccatttctgccgggctggatttcccgtccgtcggcccgcaacatgcgtatctcaacagc<br>actggacgcgctgattacgtgtctattaccgacgatgaagccctggaagcctttaaaacgctttgcctgcatgaa<br>gggatcatcccggcgctggaatcctcccacgccctggcccatgcgctgaaaatgatgcgcgaaaatccggaa<br>aaagagcagctactggtggttaacctttccggtcgcggcgataaagacatcttcaccgttcacgatattttgaaa<br>gcacgaggggaaatctga |
| TrpB<br>SEQ ID NO:<br>81 | MTTLLNPYFGEFGGMYVPQILMPALRQLEEAFVSAQKDPEFQAQFND<br>LLKNYAGRPTALTKCQNITAGTNTTLYLKREDLLHGGAHKTNQVLG<br>QALLAKRMGKTEIIAETGAGQHGVASALASALLGLKCRIYMGAKDV<br>ERQSPNVFRMRLMGAEVIPVHSGSATLKDACNEALRDWSGSYETAH<br>YMLGTAAGPHPYPTIVREFQRMIGEETKAQILEREGRLPDAVIACVGG<br>GSNAIGMFADFINETDVGLIGVEPGGHGIETGEHGAPLKHGRVGIYFG<br>MKAPMMQTEDGQIEESYSISAGLDFPSVGPQHAYLNSTGRADYVSIT<br>DDEALEAFKTLCLHEGIIPALESSHALAHALKMMRENPEKEQLLVVN<br>LSGRGDKDIFTVHDILKARGEI |
| trpA<br>SEQ ID NO:<br>82 | atggaacgctacgaatctctgtttgcccagttgaaggagcgcaaagaaggcgcattcgttcctttcgtcaccctc<br>ggtgatccgggcattgagcagtcgttgaaaattatcgatacgctaattgaagccggtgctgacgcgctggagtt<br>aggcatcccttctccgacccactggcggatggcccgacgattcaaaacgccacactgcgtgcttttgcggcg<br>ggagtaaccccggcgcagtgctttgagatgctggcactcattcgccagaagcacccgaccattccatcggcc<br>ttttgatgtatgccaacctggtgtttaacaaaggcattgatgagtttatgccgagtgcgagaaagtcggcgtcga<br>ttcggtgctggttgccgatgtgcccgtggaagagtccgcgccttccgccaggccgcgttgcgtcataatgtcg<br>cacctatctttatttgcccgccgaatgccgacgatgatttgctgcgccagatagcctcttacggtcgtggttacac<br>ctatttgctgtcgcgagcgggcgtgaccggcgcagaaaaccgcgccgcgttaccccctcaatcatctggttgcg<br>aagctgaaagagtacaacgctgcgcctccattgcagggatttggtatttccgccccggatcaggtaaaagccg<br>cgattgatgcaggagctgcgggcgcgatttctggttcggccatcgttaaaatcatcgagcaacatattaatgagc<br>cagagaaaatgctggcggcactgaaagcttttgtacaaccgatgaaagcggcgacgcgcagttaa |
| TrpA<br>SEQ ID NO:<br>83 | MERYESLFAQLKERKEGAFVPFVTLGDPGIEQSLKIIDTLIEAGADALE<br>LGIPFSDPLADGPTIQNATLRAFAAGVTPAQCFEMLALIRQKHPTIPIGL<br>LMYANLVFNKGIDEFYAECEKVGVDSVLVADVPVEESAPFRQAALR<br>HNVAPIFICPPNADDDLLRQIASYGRGYTYLLSRAGVTGAENRAALPL<br>NHLVAKLKEYNAAPPLQGFGISAPDQVKAAIDAGAAGAISGSAIVKII<br>EQHINEPEKMLAALKAFVQPMKAATRS |

In some embodiments, the genetically engineered bacteria comprise one or more nucleic acid sequence of Table 9 or a functional fragment thereof. In some embodiments, the genetically engineered bacteria comprise a nucleic acid sequence that, but for the redundancy of the genetic code, encodes the same polypeptide as one or more nucleic acid sequence of Table 9 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 9 or a functional fragment thereof, or a nucleic acid sequence that, but for the redundancy of the genetic code, encodes the same polypeptide as one or more nucleic acid sequence of Table 9 or a functional fragment thereof.

In one embodiment, one or more polypeptides and/or polynucleotides encoded and expressed by the genetically engineered bacteria have at least about 80% identity with one or more of SEQ ID NO: 71 through SEQ ID NO: 83. In one embodiment, one or more polypeptides and/or polynucleotides encoded and expressed by the genetically engineered bacteria have at least about 85% identity with one or more of SEQ ID NO: 71 through SEQ ID NO: 83. In one embodiment, one or more polypeptides and/or polynucleotides encoded and expressed by the genetically engineered bacteria have at least about 90% identity with one or more of SEQ ID NO: 71 through SEQ ID NO: 83. In one embodiment, one or more polypeptides and/or polynucleotides encoded and expressed by the genetically engineered bacteria have at least about 95% identity with one or more of SEQ ID NO: 71 through SEQ ID NO: 83. In one embodiment, one or more polypeptides and/or polynucleotides encoded and expressed by the genetically engineered bacteria have at least about 96%, 97%, 98%, or 99% identity with one or more of SEQ ID NO: 71 through SEQ ID NO: 83. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 71 through SEQ ID NO: 83. In another embodiment, one or more polynucleotides and/or polypeptides encoded and expressed by the genetically engineered bacteria comprise the sequence of one or more of SEQ ID NO: 71 through SEQ ID NO: 83. In another embodiment, one or more polynucleotides and/or polypeptides encoded and expressed by the genetically engineered bacteria consist of the sequence of one or more of SEQ ID NO: 71 through SEQ ID NO: 83.

Table 10 depicts exemplary polypeptide sequences feedback resistant AroG and TrpE. Table 10 also depicts an exemplary TnaA (tryptophanase from *E. coli*) sequence. IN some embodiments, the sequence is encoded in circuits for tryptophan catabolism to indole; in other embodiments, the sequence is deleted from the *E coli* chromosome to increase levels of tryptophan.

TABLE 10

Feedback resistant AroG and TrpE and tryptophanase sequences

| Description | Sequence |
|---|---|
| AroGfbr: feedback resistant 2-dehydro-3-deoxyphosphoheptonate aldolase from *E. coli* SEQ ID NO: 84 | MNYQNDDLRIKEIKELLPPVALLEKFPATENAANTVAHARKAI HKILKGNDDRLLVVIGPCSIHDPVAAKEYATRLLTLREELQDE LEIVMRVYFEKPRTTVGWKGLINDPHMDNSFQINDGLRIARK LLLDINDSGLPAAGEFLDMITLQYLADLMSWGAIGARTTESQ VHRELASGLSCPVGFKNGTDGTIKVAIDAINAAGAPHCFLSVT KWGHSAIVNTSGNGDCHIILRGGKEPNYSAKHVAEVKEGLNK AGLPAQVMIDFSHANSSKQFKKQMDVCTDVCQQIAGGEKAII GVMVESHLVEGNQSLESGEPLAYGKSITDACIGWDDTDALLR QLASAVKARRG |
| TrpEfbr: feedback resistant anthranilate synthase component I from *E. coli* SEQ ID NO: 85 | MQTQKPTLELLTCEGAYRDNPTALFHQLCGDRPATLLLEFADI DSKDDLKSLLLVDSALRITALSDTVTIQALSGNGEALLTLLDN ALPAGVENEQSPNCRVLRFPPVSPLLDEDARLCSLSVFDAFRL LQNLLNVPKEEREAMFFGGLFSYDLVAGFENLPQLSAENSCP DFCFYLAETLMVIDHQKKSTRIQASLFAPNEEEKQRLTARLNE LRQQLTEAAPPLPVVSVPHMRCECNQSDEEFGGVVRLLQKAI RAGEIFQVVPSRRFSLPCPSPLAAYYVLKKSNPSPYMFFMQDN DFTLFGASPESSLKYDATSRQIEIYPIAGTRPRGRRADGSLDRD LDSRIELEMRTDHKELSEHLMLVDLARNDLARICTPGSRYVA DLTKVDRYSYVMHLVSRVVGELRHDLDALHAYRACMNMGT LSGAPKVRAMQLIAEAEGRRRGSYGGAVGYFTAHGDLDTCIV IRSALVENGIATVQAGAGVVLDSVPQSEADETRNKARAVLRA IATAHHAQETF |
| SerA: 2-oxoglutarate reductase from *E. coli* Nissle SEQ ID NO: 86 | MAKVSLEKDKIKFLLVEGVHQKALESLRAAGYTNIEFHKGAL DDEQLKESIRDAHFIGLRSRTHLTEDVINAAEKLVAIGCFCIGT NQVDLDAAAKRGIPVFNAPFSNTRSVAELVIGELLLLLRGVPE ANAKAHRGVWNKLAAGSFEARGKKLGIIGYGHIGTQLGILAE SLGMYVYFYDIENKLPLGNATQVQHLSDLLNMSDVVSLHVPE NPSTKNMMGAKEISLMKPGSLLINASRGTVVDIPALCDALASK HLAGAAIDVFPTEPATNSDPFTSPLCEFDNVLLTPHIGGSTQEA QENIGLEVAGKLIKYSDNGSTLSAVNFPEVSLPLHGGRRLMHI HENRPGVLTALNKIFAEQGVNIAAQYLQTSAQMGYVVIDIEA DEDVAEKALQAMKAIPGTIRARLLY |
| SerAfbr: feedback resistant 2-oxoglutarate reductase from *E. coli* Nissle SEQ ID NO: 87 | MAKVSLEKDKIKFLLVEGVHQKALESLRAAGYTNIEFHKGAL DDEQLKESIRDAHFIGLRSRTHLTEDVINAAEKLVAIGCFCIGT NQVDLDAAAKRGIPVFNAPFSNTRSVAELVIGELLLLLRGVPE ANAKAHRGVWNKLAAGSFEARGKKLGIIGYGHIGTQLGILAE SLGMYVYFYDIENKLPLGNATQVQHLSDLLNMSDVVSLHVPE NPSTKNMMGAKEISLMKPGSLLINASRGTVVDIPALCDALASK HLAGAAIDVFPTEPATNSDPFTSPLCEFDNVLLTPHIGGSTQEA QENIGLEVAGKLIKYSDNGSTLSAVNFPEVSLPLHGGRRLMHI AEARPGVLTALNKIFAEQGVNIAAQYLQTSAQMGYVVIDIEA DEDVAEKALQAMKAIPGTIRARLLY |

TABLE 10-continued

Feedback resistant AroG and TrpE and tryptophanase sequences

| Description | Sequence |
|---|---|
| TnaA: tryptophanase from *E. coli* SEQ ID NO: 88 | MENFKHLPEPFRIRVIEPVKRTTRAYREEAIIKSGMNPFLLDSE DVFIDLLTDSGTGAVTQSMQAAMMRGDEAYSGSRSYYALAE SVKNIFGYQYTIPTHQGRGAEQIYIPVLIKKREQEKGLDRSKM VAFSNYFFDTTQGHSQINGCTVRNVYIKEAFDTGVRYDFKGN FDLEGLERGIEEVGPNNVPYIVATITSNSAGGQPVSLANLKVM YSIAKKYDIPVVMDSARFAENAYFIKQREAEYKDWTIEQITRE TYKYADMLAMSAKKDAMVPMGGLLCMKDDSFFDVYTECRT LCVVQEGFPTYGGLEGGAMERLAVGLYDGMNLDWLAYRIA QVQYLVDGLEEIGVVCQQAGGHAAFVDAGKLLPHIPADQFPA QALACELYKVAGIRAVEIGSFLLGRDPKTGKQLPCPAELLRLTI PRATYTQTHMDFIIEAFKHVKENAANIKGLTFTYEPKVLRHFT AKLKEV |

In one embodiment, one or more polypeptides and/or polynucleotides encoded and expressed by the genetically engineered bacteria have at least about 80% identity with one or more of SEQ ID NO: 84 through SEQ ID NO: 87. In one embodiment, one or more polypeptides and/or polynucleotides encoded and expressed by the genetically engineered bacteria have at least about 85% identity with one or more of SEQ ID NO: 84 through SEQ ID NO: 87. In one embodiment, one or more polypeptides and/or polynucleotides encoded and expressed by the genetically engineered bacteria have at least about 90% identity with one or more of SEQ ID NO: 84 through SEQ ID NO: 87. In one embodiment, one or more polypeptides and/or polynucleotides encoded and expressed by the genetically engineered bacteria have at least about 95% identity with one or more of SEQ ID NO: 84 through SEQ ID NO: 87. In one embodiment, one or more polypeptides and/or polynucleotides encoded and expressed by the genetically engineered bacteria have at least about 96%, 97%, 98%, or 99% identity with one or more of SEQ ID NO: 84 through SEQ ID NO: 87. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 84 through SEQ ID NO: 87. In another embodiment, one or more polynucleotides and/or polypeptides encoded and expressed by the genetically engineered bacteria comprise the sequence of one or more of SEQ ID NO: 84 through SEQ ID NO: 87. In another embodiment, one or more polynucleotides and/or polypeptides encoded and expressed by the genetically engineered bacteria consist of the sequence of one or more of SEQ ID NO: 84 through SEQ ID NO: 87.

Table 11 lists exemplary genes encoding kynureninase which are encoded by the genetically engineered bacteria of the disclosure in certain embodiments.

TABLE 11

Kynureninase protein sequences

| Description | ID | Sequence |
|---|---|---|
| *Pseudomonas* kynureninase SEQ ID NO: 89 | P83788 | MTTRNDCLALDAQDSLAPLRQQFALPEGVIYLDGNS LGARPVAALARAQAVIAEEWGNGLIRSWNSAGWRD LSERLGNRLATLIGARDGEVVVTDTTSINLFKVLSAA LRVQATRSPERRVIVTETSNFPTDLYIAEGLADMLQQ GYTLRLVDSPEELPQAIDQDTAVVMLTHVNYKTGYM HDMQALTALSHECGALAIWDLAHSAGAVPVDLHQA GADYAIGCTYKYLNGGPGSQAFVWVSPQLCDLVPQP LSGWFGHSRQFAMEPRYEPSNGIARYLCGTQPITSLA MVECGLDVFAQTDMASLRRKSLALTDLFIELVEQRC AAHELTLVTPREHAKRGSHVSFEHPEGYAVIQALIDR GVIGDYREPRIMRFGFTPLYTTFTEVWDAVQILGEILD RKTWAQAQFQVRHSVT* |
| Human SEQ ID NO: 90 | Q16719 | MEPSSLELPADTVQRIAAELKCHPTDERVALHLDEED KLRHFRECFYIPKIQDLPPVDLSLVNKDENAIYFLGNS LGLQPKMVKTYLEEELDKWAKIAAYGHEVGKRPWI TGDESIVGLMKDIVGANEKEIALMNALTVNLHLLML SFFKPTPKRYKILLEAKAFPSDHYAIESQLQLHGLNIE ESMRMIKPREGEETLRIEDILEVIEKEGDSIAVILFSGV HFYTGQHFNIPAITKAGQAKGCYVGFDLAHAVGNVE LYLHDWGVDFACWCSYKYLNAGAGGIAGAFIHEKH AHTIKPALVGWFGHELSTRFKMDNKLQLIPGVCGFRI SNPPILLVCSLHASLEIFKQATMKALRKKSVLLTGYLE YLIKHNYGKDKAATKKPVVNIITPSHVEERGCQLTITF SVPNKDVFQELEKRGVVCDKRNPNGIRVAPVPLYNS FHDVYKFTNLLTSILDSAETKN* |

TABLE 11-continued

Kynureninase protein sequences

| Description | ID | Sequence |
|---|---|---|
| Shewanella SEQ ID NO: 91 | Q8E973 | MLLNVKQDFCLAGPGYLLNHSVGRPLKSTEQALKQA FFAPWQESGREPWGQWLGVIDNFTAALASLFNGQPQ DFCPQVNLSSALTKIVMSLDRLTRDLTRNGGAVVLM SEIDFPSMGFALKKALPASCELRFIPKSLDVTDPNVW DAHICDDVDLVFVSHAYSNTGQQAPLAQIISLARERG CLSLVDVAQSAGILPLDLAKLQPDFMIGSSVKWLCSG PGAAYLWVNPAILPECQPQDVGWFSHENPFEFDIHDF RYHPTALRFWGGTPSIAPYAIAAHSIEYFANIGSQVM REHNLQLMEPVVQALDNELVSPQEVDKRSGTIILQFG ERQPQILAALAAANISVDTRSLGIRVSPHIYNDEADIA RLLGVIKANR* |

*designates the position of the stop codon

In one embodiment, one or more polypeptides and/or polynucleotides encoded and expressed by the genetically engineered bacteria have at least about 80% identity with one or more of SEQ ID NO: 89 through SEQ ID NO: 91. In one embodiment, one or more polypeptides and/or polynucleotides encoded and expressed by the genetically engineered bacteria have at least about 85% identity with one or more of SEQ ID NO: 89 through SEQ ID NO: 91. In one embodiment, one or more polypeptides and/or polynucleotides encoded and expressed by the genetically engineered bacteria have at least about 90% identity with one or more of SEQ ID NO: 89 through SEQ ID NO: 91. In one embodiment, one or more polypeptides and/or polynucleotides encoded and expressed by the genetically engineered bacteria have at least about 95% identity with one or more of SEQ ID NO: 89 through SEQ ID NO: 91. In one embodiment, one or more polypeptides and/or polynucleotides encoded and expressed by the genetically engineered bacteria have at least about 96%, 97%, 98%, or 99% identity with one or more of SEQ ID NO: 89 through SEQ ID NO: 91. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 89 through SEQ ID NO: 91. In another embodiment, one or more polynucleotides and/or polypeptides encoded and expressed by the genetically engineered bacteria comprise the sequence of one or more of SEQ ID NO: 89 through SEQ ID NO: 91. In another embodiment, one or more polynucleotides and/or polypeptides encoded and expressed by the genetically engineered bacteria consist of the sequence of one or more of SEQ ID NO: 89 through SEQ ID NO: 91.

Table 12 lists exemplary codon-optimized kynureninase cassette sequences.

TABLE 12

Selected codon-optimized kynureninase cassette sequences

| Kynureninase protein sequences | Kynureninase protein sequences |
|---|---|
| Ptet-kynU(Pseudomonas) SEQ ID NO: 92 | atctaatctagacatcattaattcctaattttgttgacactctatcattgatagagttatttta ccactccctatcagtgatagagaaaagtgaattatataaaagtgggaggtgcccgaatgacg acccgaaatgattgcctagcgttggatgcacaggacagtctggctccgctgcgccaacaatttg cgctgccggagggtgtgatatacctggatggcaattcgctgggcgcacgtccggtagctgcgc tggctcgcgcgcaggctgtgatcgcagaagaatggggcaacgggttgatccgttcatggaact ctgcgggctggcgtgatctgtctgaacgctgggtaatcgcctggctaccctgattggtgcgcg cgatggggaagtagttgttactgataccacctcgattaatctgtttaaagtgctgtcagcggcgct gcgcgtgcaagctacccgtagcccggagcgccgtgttatcgtgactgagacctcgaatttcccg accgacctgtatattgcggaagggttggcggatatgctgcaacaaggttacactctgcgtttggt ggattcaccggaagagctgccacaggctatagatcaggacaccgcggtggtgatgctgacgc acgtaaattataaaaccggttatatgcacgacatgcaggctctgaccgcgttgagccacgagtgt ggggctctggcgatttgggatctggcgcactctgctggcgctgtgccggtggaacctgcaccaa gcgggcgcggactatgcgattggctgcacgtacaaatacctgaatggcggcccgggttcgcaa gcgtttgtttgggtttcgccgcaactgtgcgacctggtaccgcagccgcgtgtctggttggttcggc catagtcgccaattcgcgatggagccgcgctacgaaccttctaacggcattgctcgctatctgtg cggcactcagcctattactagcttggctatggtggagtgcggcctggatgtgtttgcgcagacgg atatggcttcgctgcgccgtaaaagtctggcgctgactgatctgttcatcgagctggttgaacaac gctgcgctgcacacgaactgaccctggttactccacgtgaacacgcgaaacgcggctctcacg tgtcttttgaacaccccgagggttacgctgttattcaagctctgattgatcgtggcgtgatcggcga ttaccgtgagccacgtattatgcgtttcggtttcactcctctgtatactacttttacggaagtttggga tgcagtacaaatcctgggcgaaatcctggatcgtaagacttgggcgcaggctcagtttcaggtg cgccactctgttacttaaaaataaaacgaaaggctcagtcgaaagactgggcctttcgttttat ctgttg |
| Ptet-kynU(Human) SEQ ID NO: 93 | atctaatctagacatcattaattcctaattttgttgacactctatcattgatagagttatttta ccactccctatcagtgatagagaaaagtgaatatcaagacacgaggaggtaagattatgga gccttcatctttagaactgccagcggacacggtgcagcgcatcgcggcggaactgaagtgcca tccgactgatgagcgtgtggcgctgcatctggacgaagaagataaactgcgccactttcgtgaa tgttttatattcctaaaattcaagacttgccgccggtagatttgagtctcgttaacaaagatgaaaa |

TABLE 12-continued

Selected codon-optimized kynureninase cassette sequences

| Kynureninase protein sequences | Kynureninase protein sequences |
|---|---|
| | cgcgatctactttctgggcaactctctgggtctgcaaccaaaaatggttaaaacgtacctggagg<br>aagaactggataaatgggcaaaaatcgcggcttatggtcacgaagtgggcaagcgtccttggat<br>tactggcgacgagtctattgtgggtttgatgaaagatattgtgggcgcgaatgaaaaggaaattg<br>cactgatgaatgctctgaccgttaatctgcacctgctgatgctgtcttttttttaaaccgaccccgaaa<br>cgctacaaaatactgctggaagcgaaagcgtttccgtcggatcactatgctatagaaagtcaact<br>gcagttgcatggtctgaatatcgaggaatctatgcgcatgattaaaccgcgtgagggtgaagaa<br>acgctgcgtattgaagacattctggaagttattgaaaaagaaggtgattctatcgcagttatactgt<br>tttctggcgtgcactttttatacaggtcagcacttcaatatcccggcaatcactaaagcggggcagg<br>caaaaggctgctatgttggttttgacctggcgcatgcagtggggaatgttgaactgtatctgcacg<br>attggggcgttgatttcgcgtgttggtgtagctacaaatatctgaacgctggcgcgggtggcattg<br>ctggcgcttttattcacgaaaaacacgcgcacaccattaaaccggctctggttggctggttcggtc<br>atgagctgagtactcgcttttaaaatggataacaaactgcaattgattccgggtgtttgcggcttccg<br>tatcagcaatccgccgattctgctggtttgcagcctgcacgctagtctggaaatctttaagcaggc<br>gactatgaaagcgctgcgcaaaaaatctgtgctgctgaccggctatctggagtatctgatcaaac<br>acaattatggcaaagataaagctgcaactaaaaaaccggtagtgaacattatcacccccctcacac<br>gtggaggagcgcggttgtcagctgactattactttcagtgtacctaataaagatgtgttccaggaa<br>ctggaaaaacgcggcgttgtttgtgataaacgtaacccgaatggtattcgcgtggctcctgtgcc<br>gctgtacaattcattccacgatgtttataaattcaccaacctgctgacttctattctcgacagtgctga<br>gactaaaaattaactaataaaacgaaaggctcagtcgaaagactgggcctttcgttttatctgttg |
| ptet-<br>kynU(Shewanella)<br>SEQ ID NO: 94 | atctaatctagacatcattaattcctaattttgttgacactctatcattgatagagttatttta<br>ccactccctatcagtgatagagaaaagtgaatggttcaccaccacaaggagggatt atgctg<br>ctgaatgtaaaacaggacttttgcctggcaggcccgggctacctgctgaatcactcggttggcc<br>gtccgctgaaatcaactgagcaagcgctgaaacaagcattttttgctccgtggcaagagagcgg<br>tcgtgaaccgtgggccagtggctgggtgttattgataatttcactgctgcgctggcatctctgttt<br>aatggtcaaccgcaggattttttgtccgcaggttaacctgagcagcgcgctgactaaaattgtgat<br>gtcactggatcgtctgactcgcgatctgacccgcaatggcggtgctgttgtgctgatgtctgaaat<br>cgatttccatctatgggcttcgcgttgaaaaaagcgctgccagcgagctgcgaactgcgttttat<br>cccgaaaagtctggacgtgactgatccgaacgtatgggatgcacacatctgtgatgatgtagac<br>ctggttttttgtgtctcacgcctatagtaatacgggccaacaggctccgctggcgcaaatcatctct<br>ctggcgcgtgaacgtggctgcctgtcactggtggatgtagcgcaatcagcggggattttgccgc<br>tggatctggcgaaactgcaaccggacttcatgatcggcagttcggttaaatggctgtgctcgggc<br>cctggtgcggcatatctgtgggttaatccggcgattctgccggaatgtcagccgcaggatgtgg<br>gctggttttcacatgagaatcccttttgaattcgacatccacgatttccgctaccacccgactgcact<br>gcgcttttggggtggtacgccgtcgatcgcgccttatgcgatcgcggcgcactcgatcgaatatt<br>ttgccaatatcggctcgcaagtgatgcgtgaacacaacctgcaactgatggaaccggtggttca<br>ggcgctggacaatgaactggtgagcccgcaggaagtggataaacgctcaggcactattattctg<br>caattcggtgaacgtcaaccgcaaattctggcggctctggctgcggcgaacatttcggtggaca<br>ctcgttctttggggattcgtgttagtccgcacatttataatgatgaggcggacattgcgcgcctgct<br>gggtgtgatcaaagcaaatcgctaaaaataaaacgaaaggctcagtcgaaagactgggcctttc<br>*gttttatctgttg* |

The ptet-promoter is in bold, designed Ribosome binding site is underlined, codon-optimized protein coding sequence is in plain text, and the terminator is in italics.

In some embodiments, the genetically engineered bacteria comprise one or more nucleic acid sequence of Table 12 or a functional fragment thereof. In some embodiments, the genetically engineered bacteria comprise a nucleic acid sequence that, but for the redundancy of the genetic code, encodes the same polypeptide as one or more nucleic acid sequence of Table 12 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 12 or a functional fragment thereof, or a nucleic acid sequence that, but for the redundancy of the genetic code, encodes the same polypeptide as one or more nucleic acid sequence of Table 12 or a functional fragment thereof.

In one embodiment, one or more polynucleotides encoded and expressed by the genetically engineered bacteria have at least about 80% identity with one or more of SEQ ID NO: 92 through SEQ ID NO: 94. In one embodiment, one or more polynucleotides encoded and expressed by the genetically engineered bacteria have at least about 85% identity with one or more of SEQ ID NO: 92 through SEQ ID NO: 94. In one embodiment, one or more polynucleotides encoded and expressed by the genetically engineered bacteria have at least about 90% identity with one or more of SEQ ID NO: 92 through SEQ ID NO: 94. In one embodiment, one or more polynucleotides encoded and expressed by the genetically engineered bacteria have at least about 95% identity with one or more of SEQ ID NO: 92 through SEQ ID NO: 94. In one embodiment, one or more polynucleotides encoded and expressed by the genetically engineered bacteria have at least about 96%, 97%, 98%, or 99% identity with one or more of SEQ ID NO: 92 through SEQ ID NO: 94. Accordingly, in one embodiment, one or more polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 92 through SEQ ID NO: 94. In another embodiment, one or more polynucleotides encoded and expressed by the genetically engineered bacteria comprise the sequence of one or more of SEQ ID NO: 92 through SEQ ID NO: 94. In another embodiment, one or more polynucleotides encoded and expressed by the genetically engineered bacteria consists of the sequence of one or more of SEQ ID NO: 92 through SEQ ID NO: 94.

The genetically engineered bacteria may comprise any suitable gene for producing kynureninase. In some embodiments, the gene for producing kynureninase is modified and/or mutated, e.g., to enhance stability, increase kynureninase production. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing kynureninase under inducing conditions, e.g., under a condition(s) associated with inflammation. In some embodiments, the genetically engineered bacteria are capable of producing kynureninase in low-oxygen conditions, in the presence of certain molecules or metabolites, in the presence of molecules or metabolites associated with inflammation or an inflammatory response, or in the presence of some other metabolite that may or may not be present in the gut, such as arabinose.

The genetically engineered bacteria may comprise any suitable gene for producing kynureninase. In some embodiments, the gene for producing kynureninase is modified and/or mutated, e.g., to enhance stability, increase kynureninase production. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing kynureninase under inducing conditions, e.g., under a condition(s) associated with inflammation. In some embodiments, the genetically engineered bacteria are capable of producing kynureninase in low-oxygen conditions. In some embodiments, the genetically engineered bacteria are capable of producing kynureninase in the presence of certain molecules or metabolites, in the presence of molecules or metabolites associated with inflammation or an inflammatory response, or in the presence of some other metabolite that may or may not be present in the gut, such as arabinose.

Producing Kynurenic Acid

In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. Kynurenic acid acts as an antagonist of ionotropic glutamate receptors (Turski et al., 2013). While glutamate is known to be a major excitatory neurotransmitter in the central nervous system, there is now evidence to suggest an additional role for glutamate in the peripheral nervous system. For example, the activation of NMDA glutamate receptors in the major nerve supply to the GI tract (i.e., the myenteric plexus) leads to an increase in gut motility (Forrest et al., 2003), but rats treated with kynurenic acid exhibit decreased gut motility and inflammation in the early phase of acute colitis (Varga et al., 2010). Thus, the elevated levels of kynurenic acid reported in IBD patients may represent a compensatory response to the increased activation of enteric neurons (Forrest et al., 2003). The genetically engineered bacteria may comprise any suitable gene or genes for producing kynurenic acid. In some embodiments, the engineered bacteria comprise gene sequence(s) encoding one or more kynurenine-oxoglutarate transaminases (also referred to as kynurenine aminotransferases (e.g., KAT I, II, III)).

In some embodiments, the gene or genes for producing kynurenic acid is modified and/or mutated, e.g., to enhance stability, increase kynurenic acid production under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with inflammation or an inflammatory response, or in the presence of some other metabolite that may or may not be present in the gut, such as arabinose.

In some embodiments, the genetically engineered bacteria comprise one or more gene(s) or gene cassette(s) for the consumption of tryptophan and production of kynurenic acid, which are bacterially derived. In some embodiments, the enzymes for producing kynureic acid are derived from one or more of *Pseudomonas, Xanthomonas, Burkholderia, Stenotrophomonas, Shewanella*, and *Bacillus*, and/or members of the families Rhodobacteraceae, Micrococcaceae, and Halomonadaceae, In some embodiments the enzymes are derived from the species listed in table S7 of Vujkovic-Cvijin et al. (Dysbiosis of the gut microbiota is associated with HIV disease progression and tryptophan catabolism Sci Transl Med. 2013 Jul. 10; 5(193): 193ra91), the contents of which is herein incorporated by reference in its entirety.

In some embodiments, the genetically engineered bacteria comprise gene sequence(s) encoding one or more tryptophan transporters and gene sequence(s) encoding kynureninase. In some embodiments, the genetically engineered bacteria comprise gene sequence(s) encoding one or more tryptophan transporters and gene sequence(s) encoding one or more kynurenine-oxoglutarate transaminases (kynurenine aminotransferases). In some embodiments, the genetically engineered bacteria comprise gene sequence(s) encoding one or more tryptophan transporters, gene sequence(s) encoding kynureninase, and gene sequence(s) encoding one or more kynurenine-oxoglutarate transaminases (kynurenine aminotransferases). In some embodiments, the genetically engineered bacteria comprise gene sequence(s) encoding kynureninase and gene sequence(s) encoding one or more kynurenine aminotransferases.

In some embodiments, the one or more genes for producing kynurenic acid are modified and/or mutated, e.g., to enhance stability, increase kynurenic acid production under inducing conditions. In some embodiments, the engineered bacteria have enhanced uptake or import of tryptophan, e.g., comprise a transporter or other mechanism for increasing the uptake of tryptophan into the bacterial cell. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with inflammation or an inflammatory response, or in the presence of some other metabolite that may or may not be present in the gut, such as arabinose.

In some embodiments, the genetically engineered bacteria are capable of expressing any one or more of the described circuits in low-oxygen conditions, in the presence of disease or tissue specific molecules or metabolites, in the presence of molecules or metabolites associated with inflammation or an inflammatory response or immune suppression or in the presence of some other metabolite that may or may not be present in the gut, such as arabinose. In some embodiments, any one or more of the described circuits are present on one or more plasmids (e.g., high copy or low copy) or are integrated into one or more sites in the bacterial chromosome. Also, in some embodiments, the genetically engineered bacteria are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, and (6) combinations of one or more of such additional circuits.

Producing Indole Tryptophan Metabolites and Tryptamine

Tryptamine

Figure 36A:
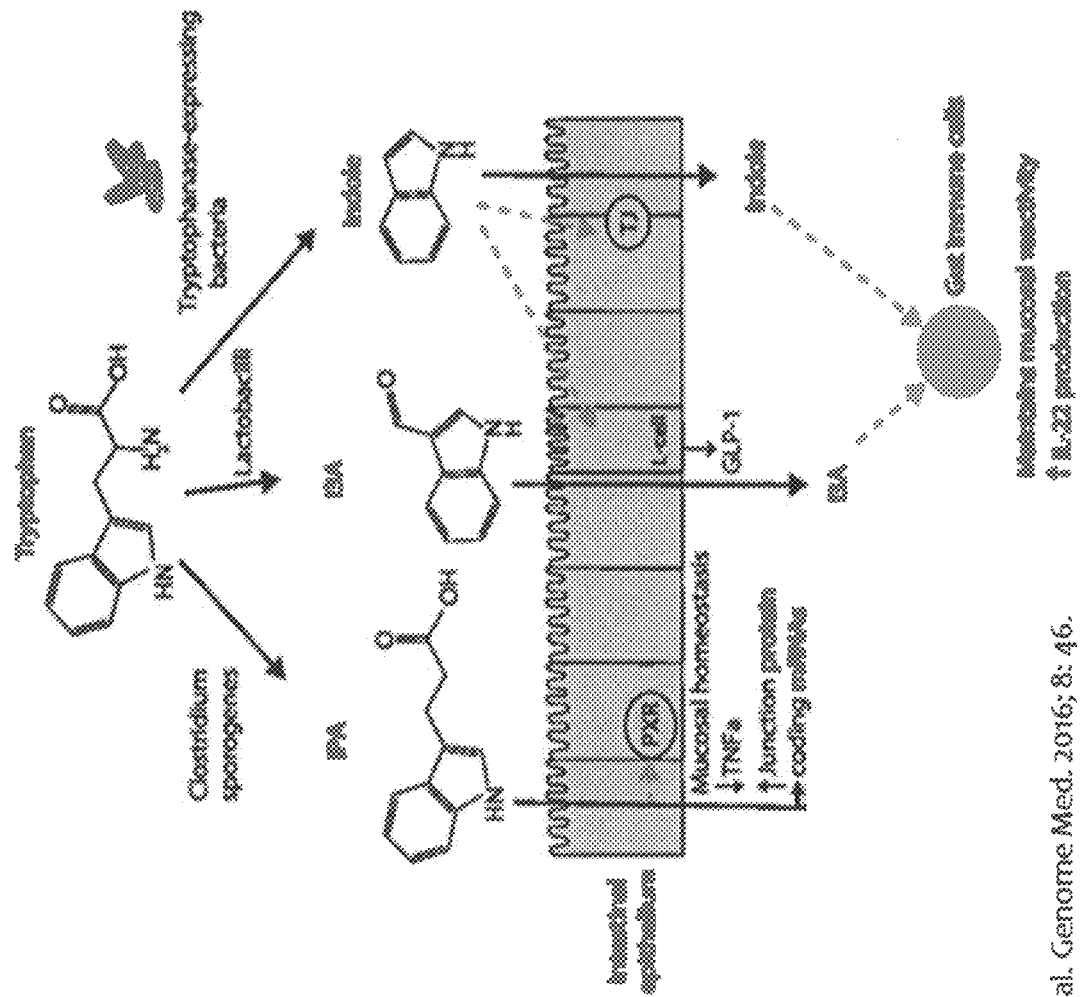
FIG. 36A and FIG. 36B depict schematics of indole metabolite mode of action (FIG. 36A) and indole biosynthesis (FIG. 36B).
Figure 36B:
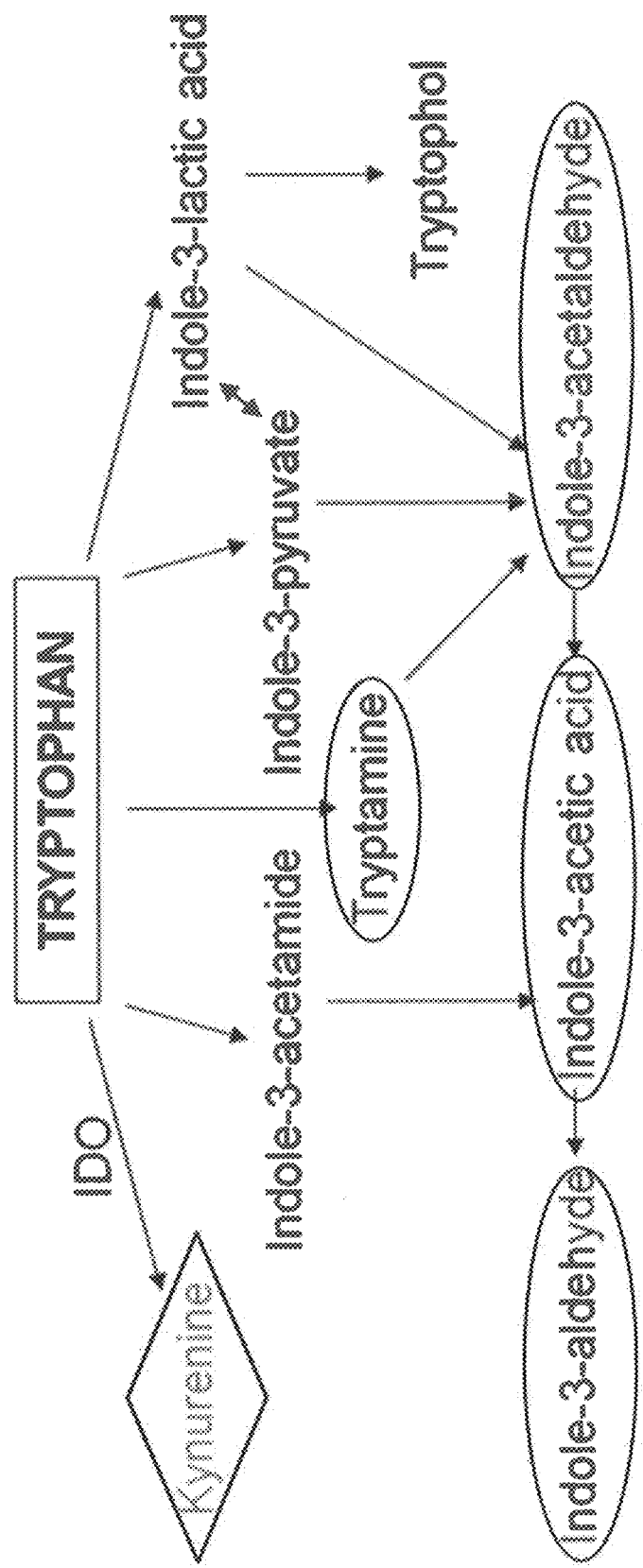

In some embodiments the genetically engineered bacteria comprise one or more gene sequence(s) which encode one or more tryptophan catabolism enzymes, produce tryptamine from tryptophan. The monoamine alkaloid, tryptamine, is derived from the direct decarboxylation of tryptophan. Tryptophan is converted to indole-3-acetic acid (IAA) via the enzymes tryptophan monooxygenase (IaaM) and indole-3-acetamide hydrolase (IaaH), which constitute the indole-3-acetamide (IAM) pathway, see eg., FIG. 36B, FIG. 37A and FIG. 37B.

A non-limiting example of such as strain is shown in FIG. 41. In one embodiment, the genetically engineered bacteria comprise one or more gene sequence(s) which encode one or more Tryptophan decarboxylase(s). e.g., from *Catharanthus roseus*. In one embodiment the genetically engineered bacteria comprise one or more gene sequence(s) which encode one or more Tryptophan decarboxylase(s). e.g., from *Catharanthus roseus*. In one embodiment the genetically engineered bacteria comprise one or more gene sequence(s) which encode one or more Tryptophan decarboxylase(s) e.g., from *Ruminococcus Gnavus*.

Figure 45C:
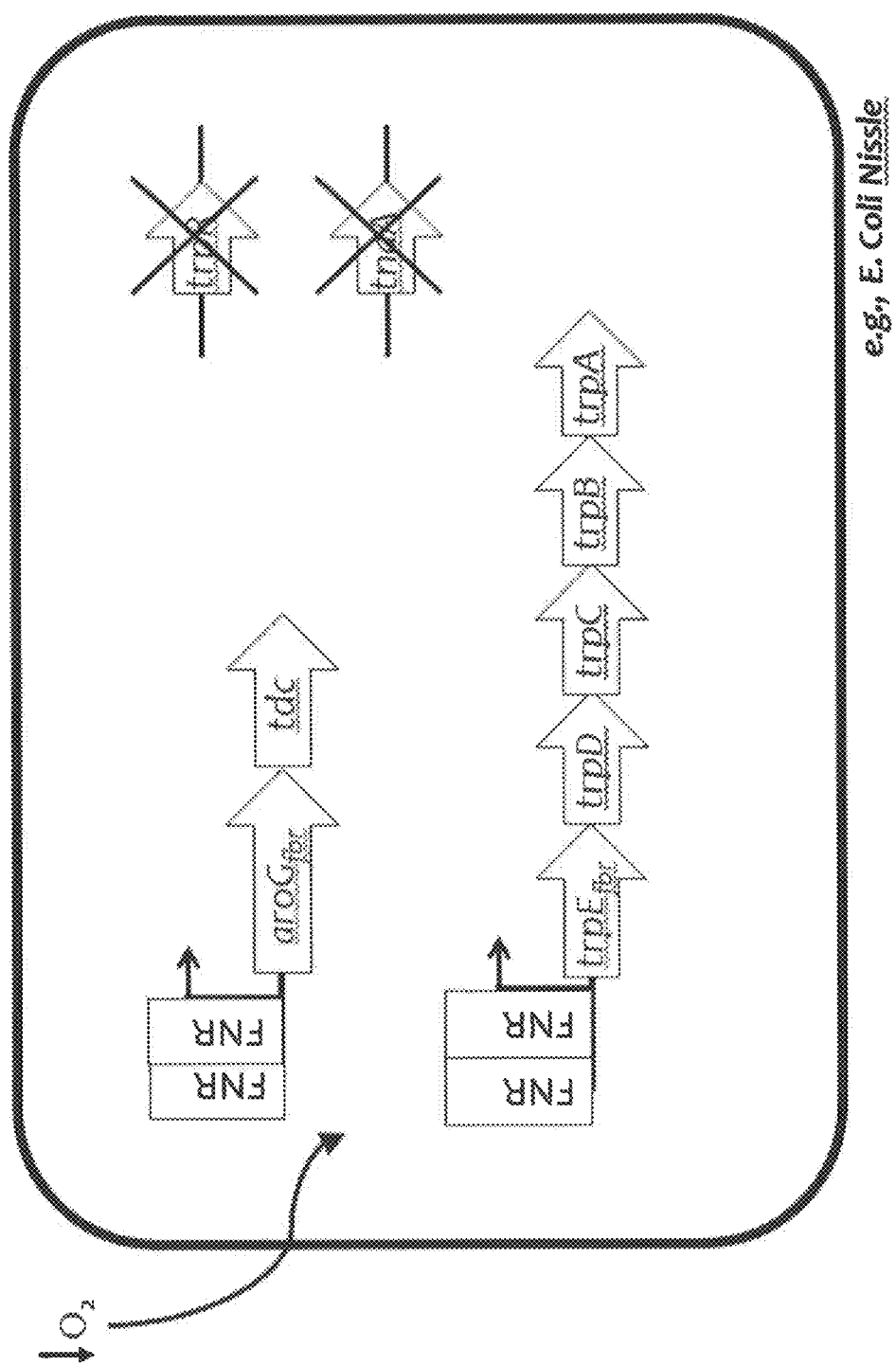

Another non-limiting example of such as strain is shown in FIG. 45C. In one embodiment, the genetically engineered bacteria comprise one or more gene sequence(s) which encode tdc from *Catharanthus roseus*.

In some embodiments, the genetically engineered bacteria which produce tryptamine from tryptophan also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce tryptamine from tryptophan also optionally comprise one or more gene sequence(s) which encode one or more transporter(s) as described herein, through which tryptophan can be imported. Optionally, In some embodiments, the genetically engineered bacteria which produce tryptamine from tryptophan also optionally comprise one or more gene sequence(s) which encode an exporter as described herein, which can export tryptophan or any of its metabolites.

Indole-3-acetaldehyde and FICZ

Figure 41A:
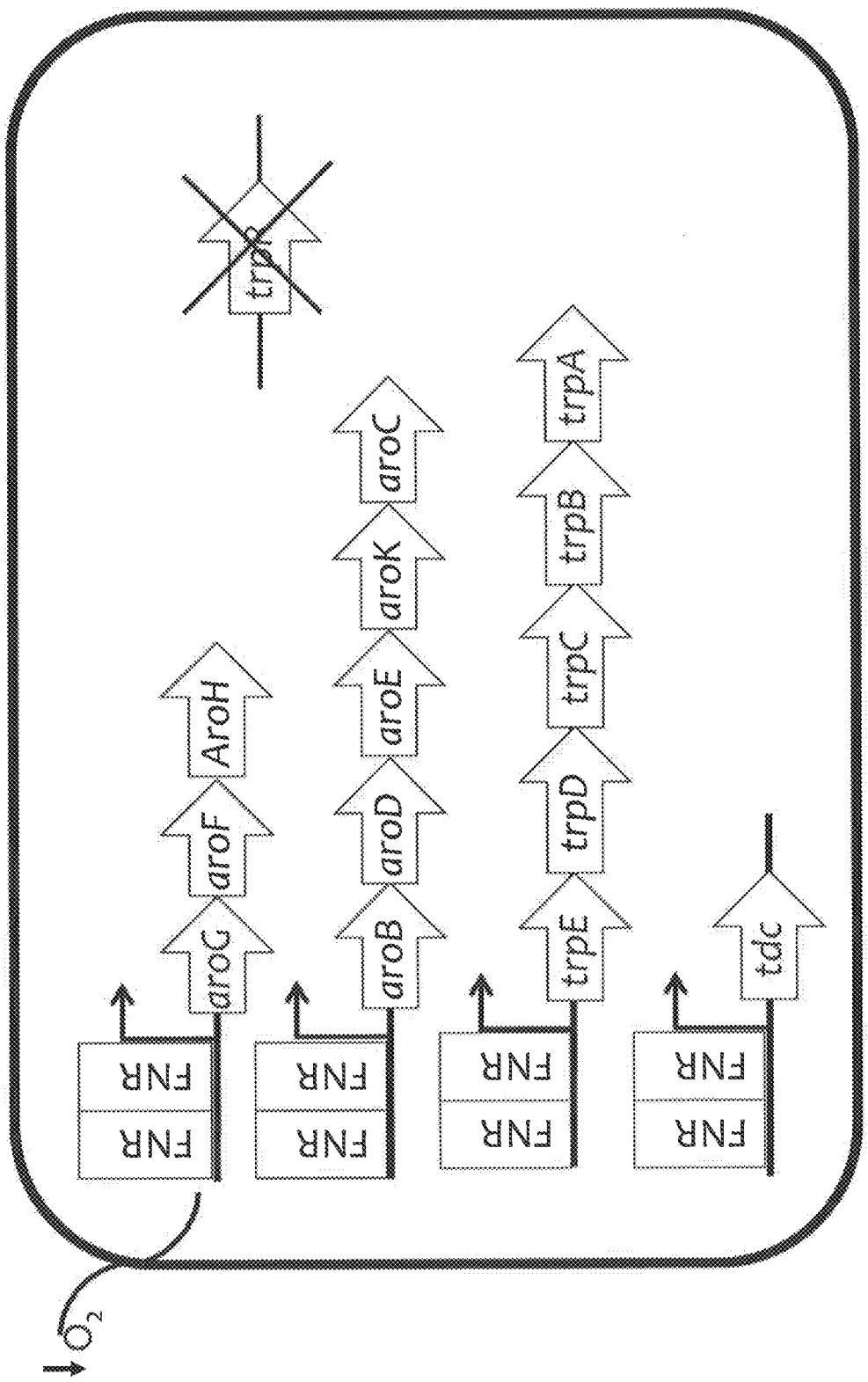
FIG. 41A, FIG. 41B, FIG. 41C, FIG. 41D, FIG. 41E, FIG. 41F, FIG. 41G, and FIG. 41H depict schematics of non-limiting examples of embodiments of the disclosure. In all embodiments, optionally gene(s) which encode exporters may also be included.
Figure 41B:
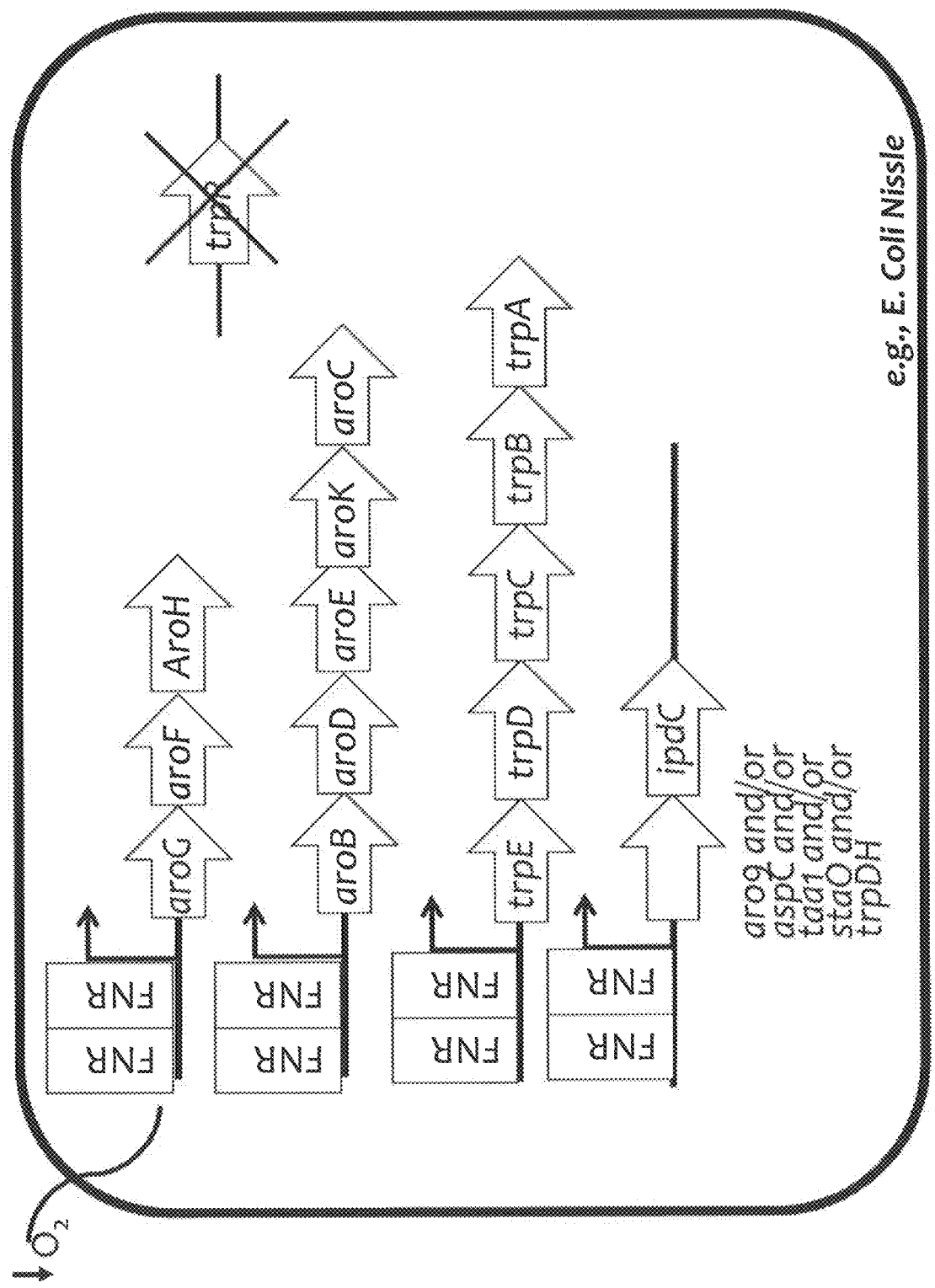

In one embodiment, the genetically engineered bacteria comprise one or more gene sequence(s) which encode one or more tryptophan catabolism enzymes, which produce indole-3-acetaldehyde and FICZ from tryptophan. Exemplary gene cassettes for the production of produce indole-3-acetaldehyde and FICZ from tryptophan are shown in FIG. 41B.

In one embodiment, the genetically engineered bacteria comprise one or more gene sequence(s) which encode aro9 (L-tryptophan aminotransferase). In one embodiment, the (L-tryptophan aminotransferase is from *S. cerevisiae*. In one embodiment, the genetically engineered bacteria comprise one or more gene sequence(s) which encode ipdC (Indole-3-pyruvate decarboxylase, e.g., from *Enterobacter cloacae*). In one embodiment, the genetically engineered bacteria comprise one or more gene sequence(s) which encode aro9 and ipdC. In one embodiment, the genetically engineered bacteria comprise one or more gene sequence(s) which encode aspC (aspartate aminotransferase. In one embodiment, the genetically engineered bacteria comprise one or more gene sequence(s) which encode aspC from *E. coli*. In one embodiment, the genetically engineered bacteria comprise one or more gene sequence(s) which encode aspC and ipdC. In one embodiment, the genetically engineered bacteria comprise one or more gene sequence(s) which encode taa1 (L-tryptophan-pyruvate aminotransferase, In one embodiment, the genetically engineered bacteria comprise one or more gene sequence(s) which encode taa1 from *Arabidopsis thaliana*. In one embodiment, the genetically engineered bacteria comprise one or more gene sequence(s) which encode taa1 and ipdC. In one embodiment, the genetically engineered bacteria comprise one or more gene sequence(s) which encode staO (L-tryptophan oxidase). In one embodiment, the genetically engineered bacteria comprise one or more gene sequence(s) which encode staO from *streptomyces* sp. TP-A0274. In one embodiment, the genetically engineered bacteria comprise one or more gene sequence(s) which encode staO and ipdC. In one embodiment, the genetically engineered bacteria comprise one or more gene sequence(s) which encode trpDH (Tryptophan dehydrogenase). In one embodiment, the genetically engineered bacteria comprise one or more gene sequence(s) which encode trpDH from *Nostoc punctiforme* NIES-2108. In one embodiment, the genetically engineered bacteria comprise one or more gene sequence(s) which encode trpDH and ipdC. In one embodiment, the genetically engineered bacteria comprise one or more gene sequence(s) which encode one or more of aro9 or aspC or taa1 or staO or trpDH. In one embodiment, the genetically engineered bacteria comprise one or more gene sequence(s) which encode one or more of aro9 or aspC or taa1 or staO or trpDH and ipdC.

Figure 41C:
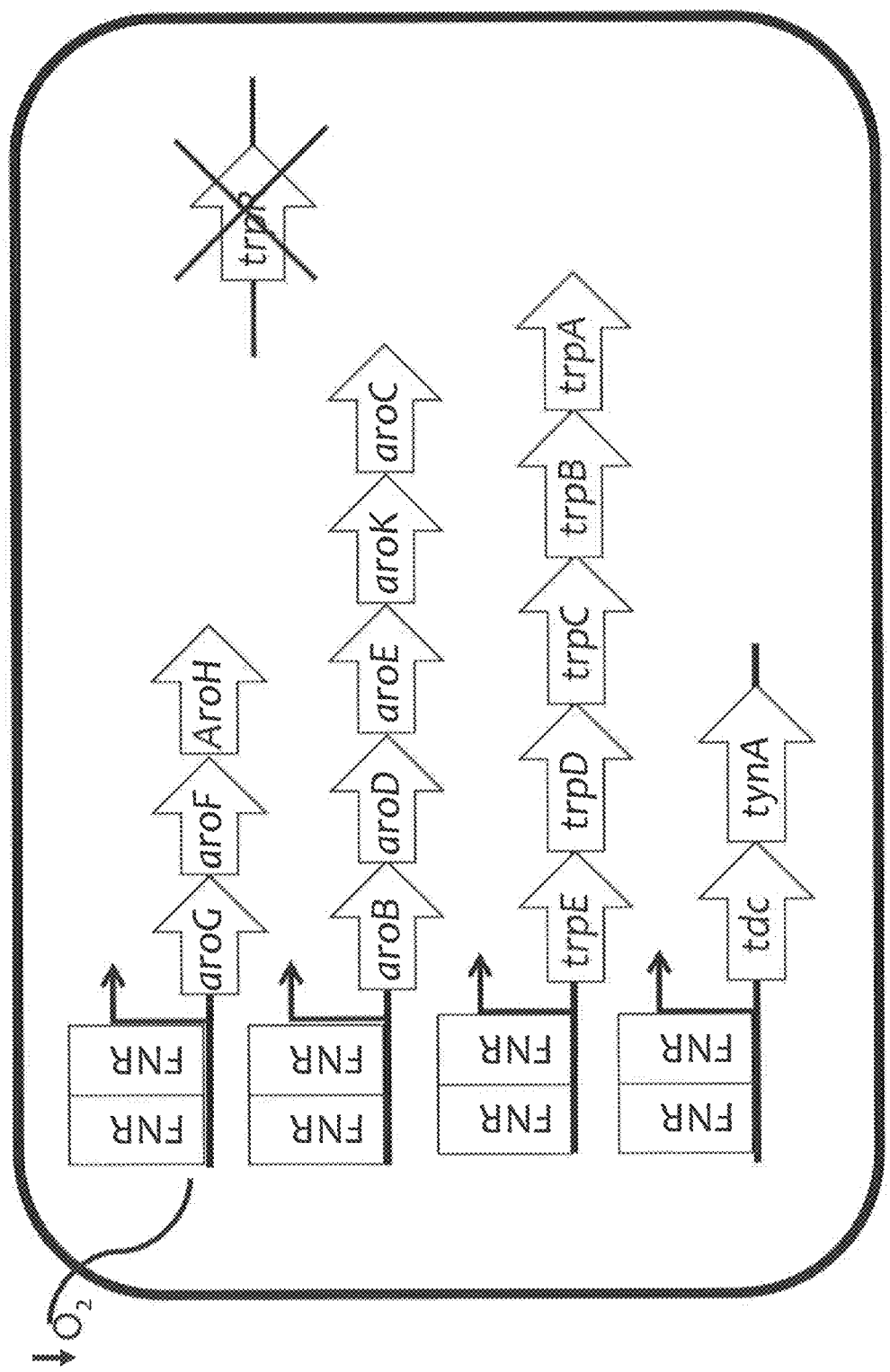

Further exemplary gene cassettes for the production of produce indole-3-acetaldehyde and FICZ from tryptophan are shown in FIG. 41C. In one embodiment, the genetically engineered bacteria comprise one or more gene sequence(s) which encode tdc (Tryptophan decarboxylase). In one embodiment, the genetically engineered bacteria comprise one or more gene sequence(s) which encode tdc from *Catharanthus roseus*. In one embodiment, the genetically engineered bacteria comprise one or more gene sequence(s) which encode tynA (Monoamine oxidase). In one embodiment, the genetically engineered bacteria comprise one or more gene sequence(s) which encode tynA from *E. coli*. In one embodiment, the genetically engineered bacteria comprise one or more gene sequence(s) which encode tdc and tynA.

In any of these embodiments, the genetically engineered bacteria which produce indole-3-acetaldehyde and FICZ also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce indole-3-acetaldehyde and FICZ also optionally comprise one or more gene sequence(s) which encode one or more transporter(s) as described herein, through which tryptophan can be imported. Optionally, in some embodiments, the genetically engineered bacteria which produce indole-3-acetaldehyde and FICZ also optionally comprise one or more gene sequence(s) which encode an exporter as described herein, which can export tryptophan or any of its metabolites.

Indole-3-acetonitrile

Figure 41D:
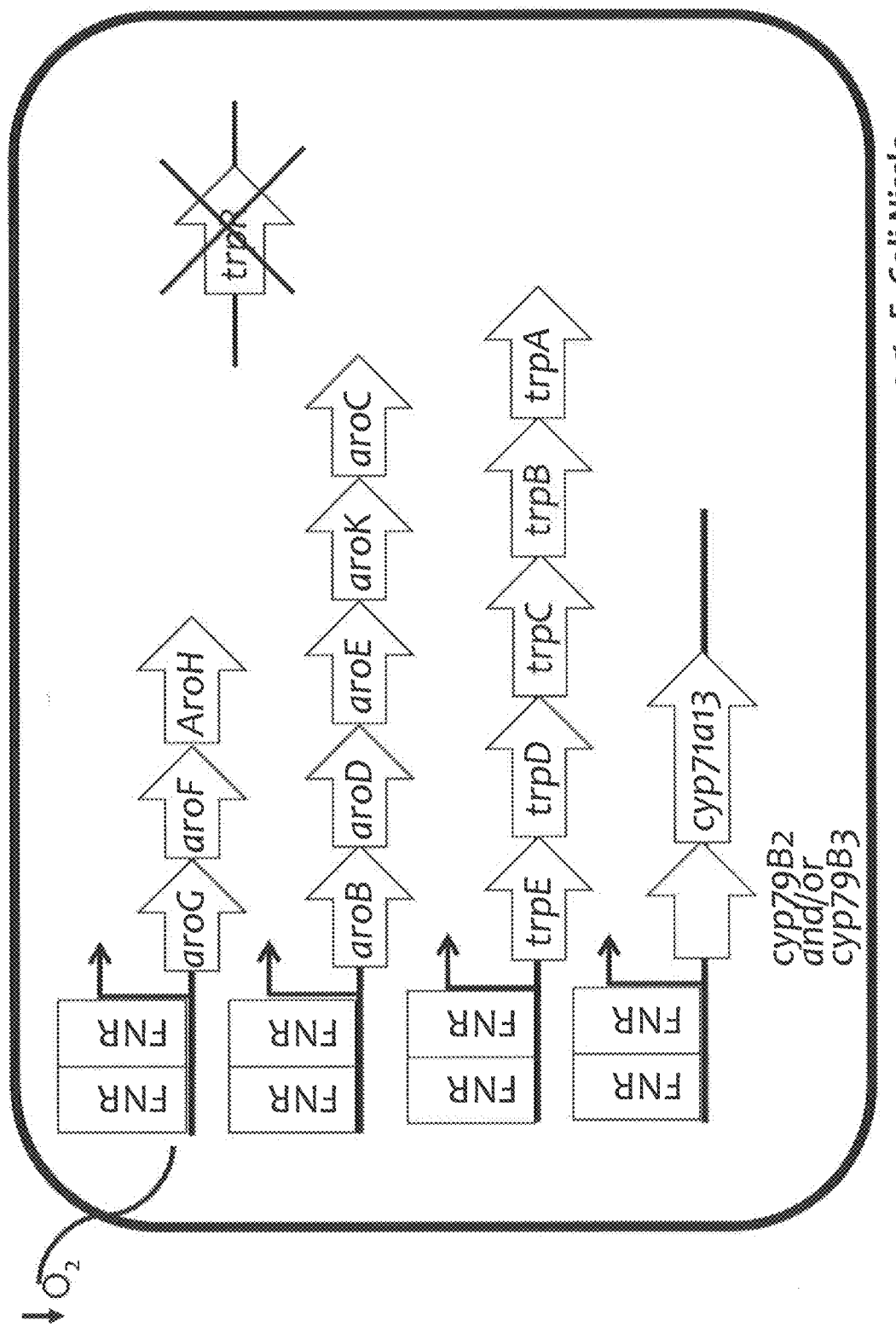
Figure 41E:
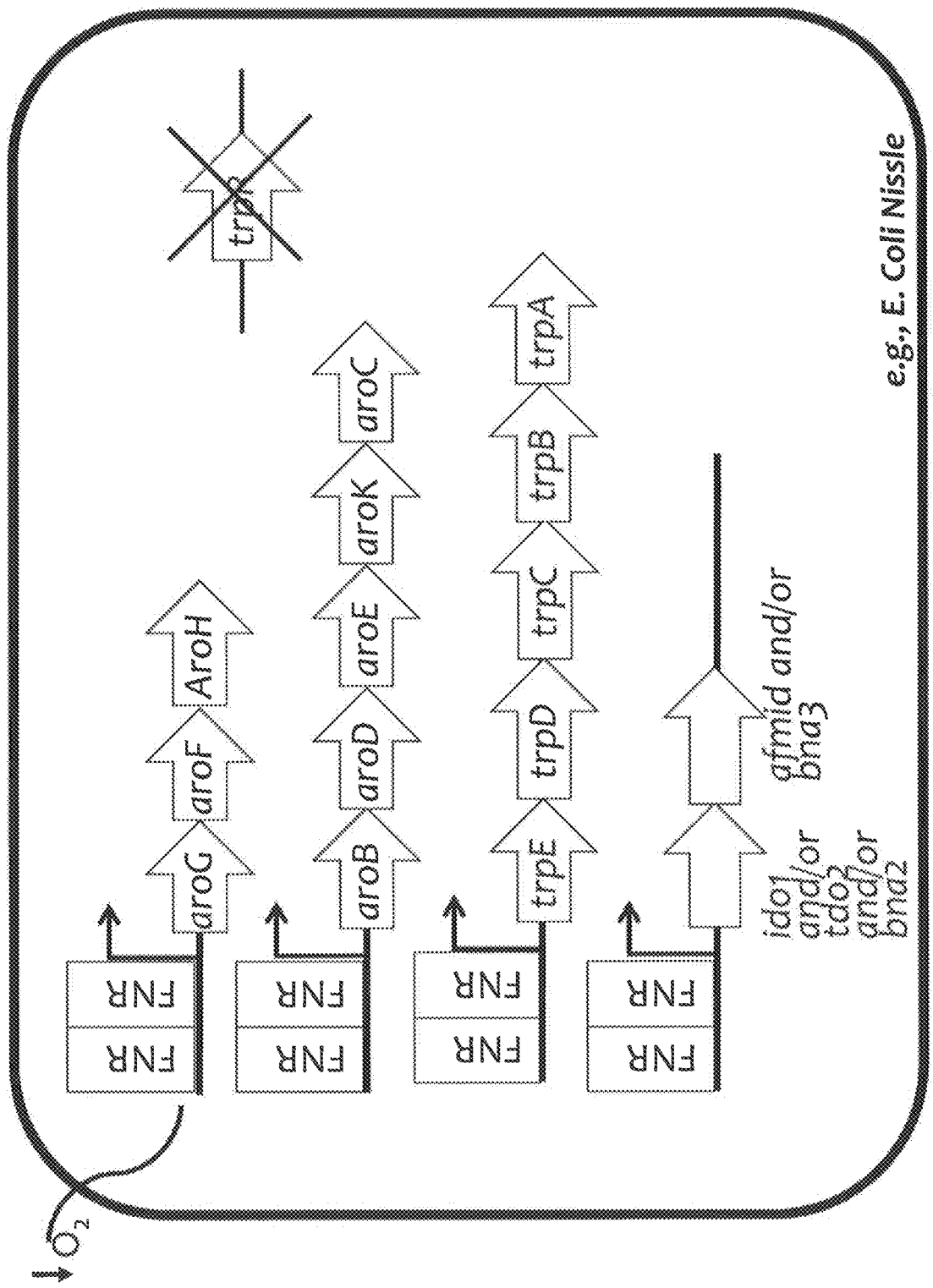
Figure 41F:
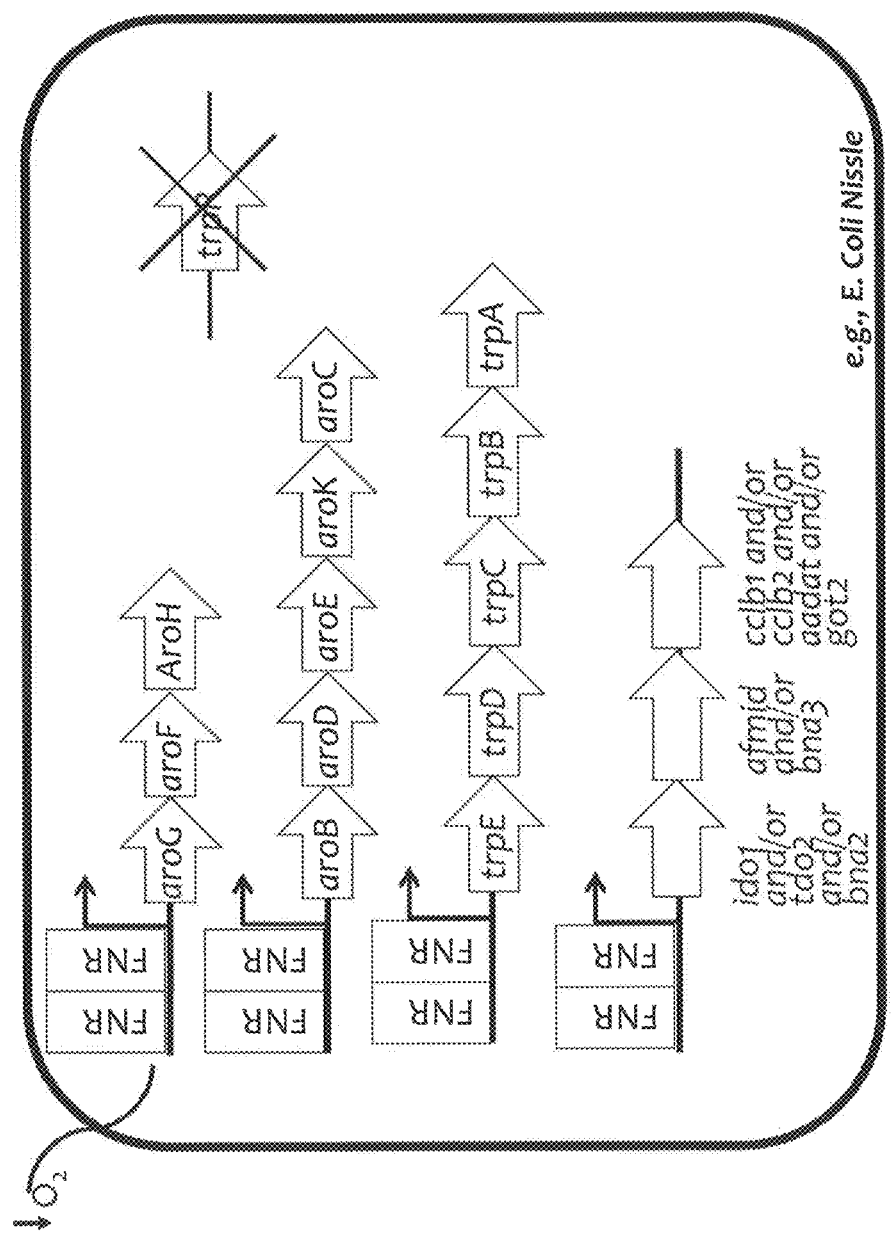
Figure 41G:
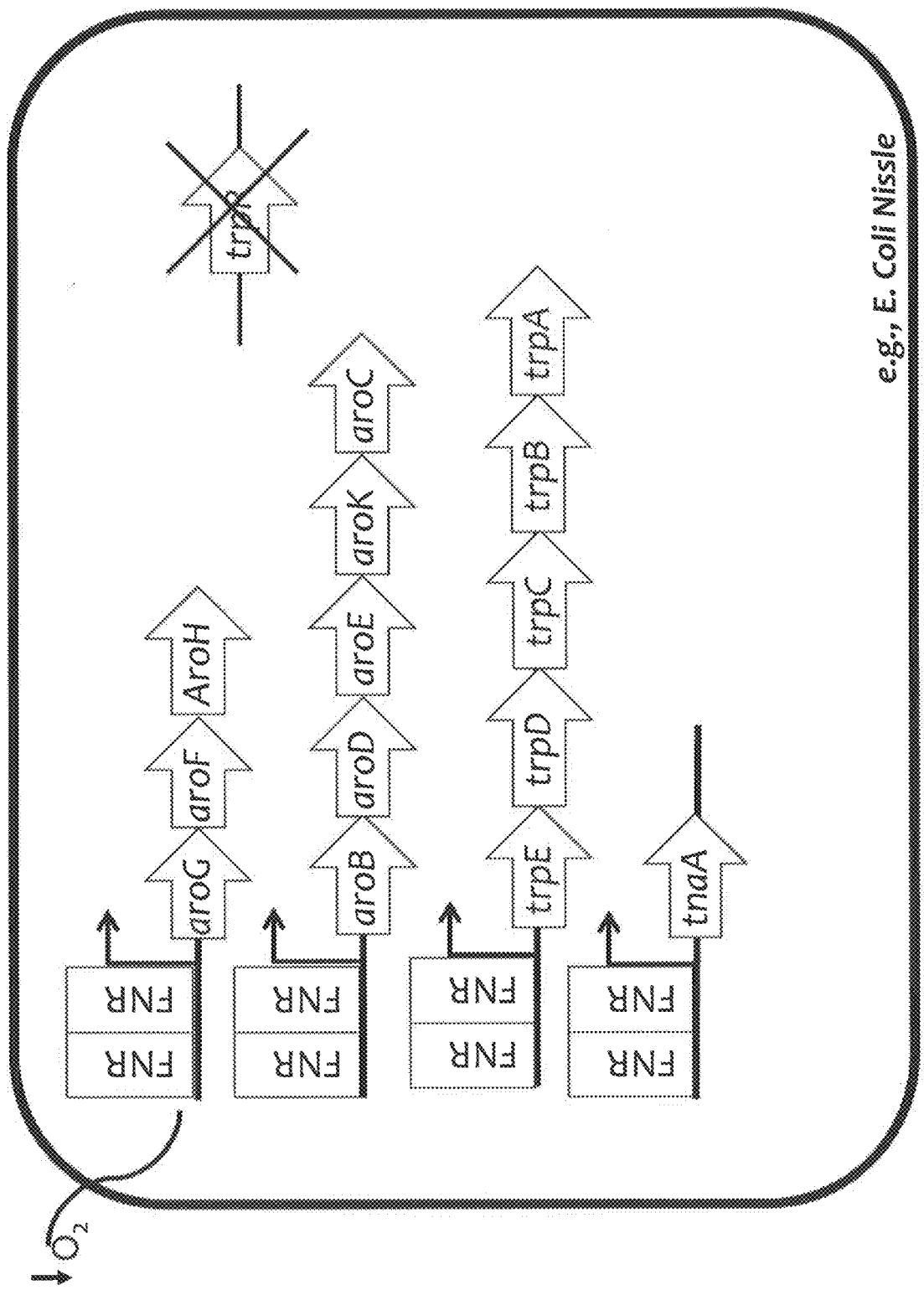
Figure 41H:
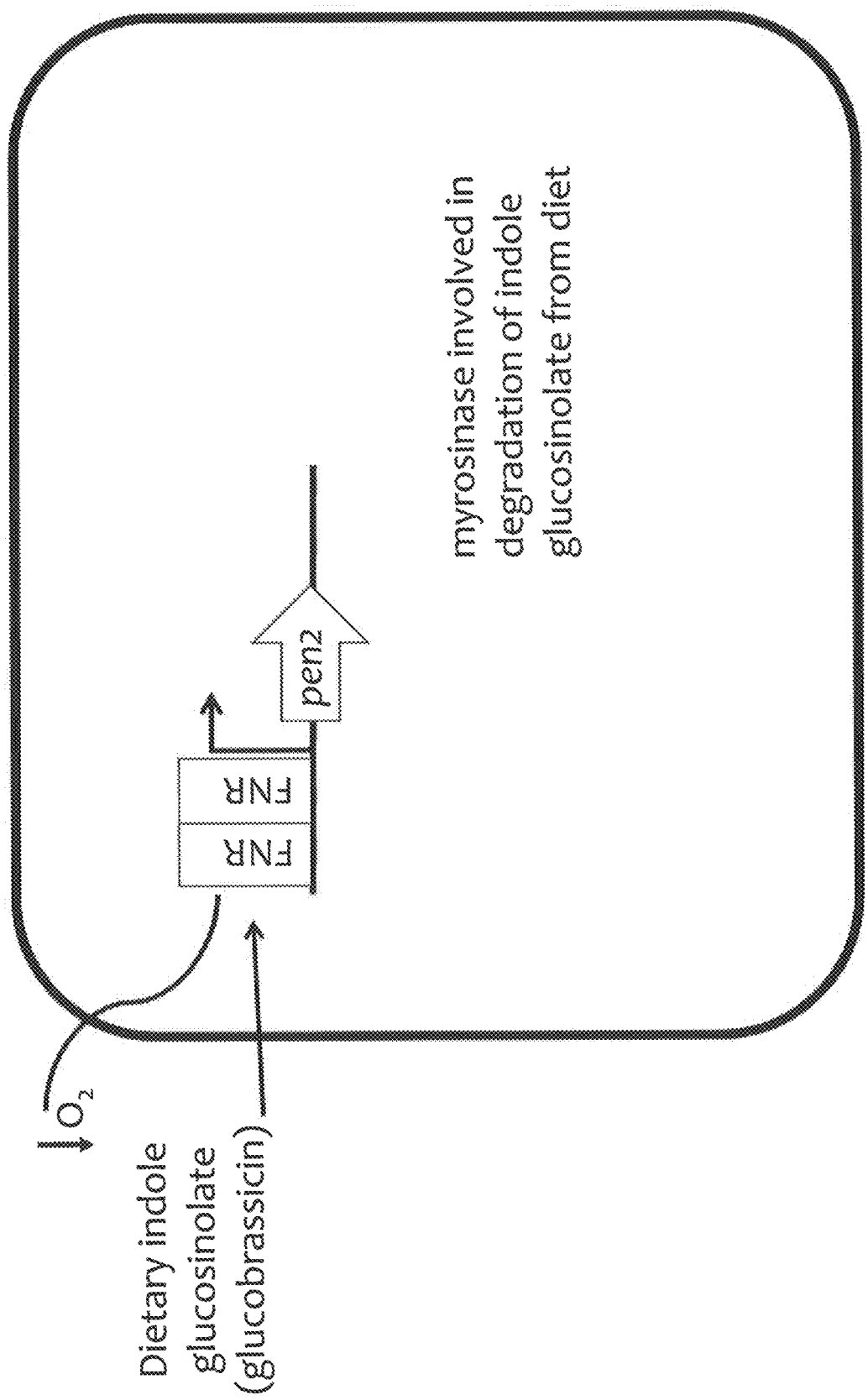

In one embodiment, the genetically engineered bacteria comprise one or more gene sequence(s) which encode one or more tryptophan catabolism enzymes, which produce indole-3-acetonitrile from tryptophan. A non-limiting example of such gene sequence(s) which allow in which the genetically engineered bacteria to produce indole-3-acetonitrile from tryptophan is depicted in FIG. 41D.

In one embodiment, the genetically engineered bacteria comprise one or more gene sequence(s) which encode cyp79B2 (tryptophan N-monooxygenase). In one embodiment, the genetically engineered bacteria comprise one or more gene sequence(s) which encode cyp79B2 from *Arabidopsis thaliana*. In one embodiment, the genetically engineered bacteria comprise one or more gene sequence(s) which encode cyp71a13 (indoleacetaldoxime dehydratase). In one embodiment, the genetically engineered bacteria comprise one or more gene sequence(s) which encode cyp71a13 from *Arabidopsis thaliana*. In one embodiment, the genetically engineered bacteria comprise one or more gene sequence(s) which encode cyp79B2 and cyp71a13.

In one embodiment, the genetically engineered bacteria comprise one or more gene sequence(s) which encode cyp79B3 (tryptophan N-monooxygenase) In one embodiment, the genetically engineered bacteria comprise one or more gene sequence(s) which encode cyp79B3 from *Arabidopsis thaliana*. In one embodiment, the genetically engineered bacteria comprise one or more gene sequence(s) which encode cyp79B3 and cyp71a13. In one embodiment, the genetically engineered bacteria comprise one or more gene sequence(s) which encode cyp79B3, cyp79B2 and cyp71a13.

In any of these embodiments, the genetically engineered bacteria which produce indole-3-acetonitrile from tryptophan also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce indole-3-acetonitrile from tryptophan also optionally comprise one or more gene sequence(s) which encode one or more transporter(s) as described herein, through which tryptophan can be imported. Optionally, in some embodiments, the genetically engineered bacteria which produce indole-3-acetonitrile from tryptophan also optionally comprise one or more gene sequence(s) which encode an exporter as described herein, which can export tryptophan or any of its metabolites.

Kynurenine

In one embodiment, the genetically engineered bacteria comprise one or more gene sequence(s) which encode one or more tryptophan catabolism enzymes, which produce kynurenine from tryptophan. Non-limiting example of such gene sequence(s) are shown FIG. 41E and described elsewhere herein. In one embodiment, the genetically engineered bacteria comprise one or more gene sequence(s) which encode IDO1 (indoleamine 2,3-dioxygenase). In one embodiment, the genetically engineered bacteria comprise one or more gene sequence(s) which encode IDO1 from *Homo sapiens*. In one embodiment, the genetically engineered bacteria comprise one or more gene sequence(s) which encode TDO2 (tryptophan 2,3-dioxygenase). In one embodiment, the genetically engineered bacteria comprise one or more gene sequence(s) which encode TDO2 from *Homo sapiens*. In one embodiment, the genetically engineered bacteria comprise one or more gene sequence(s) which encode BNA2 (indoleamine 2,3-dioxygenase). In one embodiment, the genetically engineered bacteria comprise one or more gene sequence(s) which encode BNA2 from *S. cerevisiae*). In one embodiment, the genetically engineered bacteria comprise one or more gene sequence(s) which encode Afmid: Kynurenine formamidase. In one embodiment, the genetically engineered bacteria comprise one or more gene sequence(s) which encode Afmid: Kynurenine formamidase from mouse. In one embodiment, the genetically engineered bacteria comprise one or more gene sequence(s) which encode Afmid in combination with one or more of ido1 and/or tdo2 and/or bna2. In one embodiment, the genetically engineered bacteria comprise one or more gene sequence(s) which encode Afmid in combination with ido1. In one embodiment, the genetically engineered bacteria comprise one or more gene sequence(s) which encode BNA2 in combination with tdo2. In one embodiment, the genetically engineered bacteria comprise one or more gene sequence(s) which encode Afmid in combination with bna2. In one embodiment, the genetically engineered bacteria comprise one or more gene sequence(s) which encode BNA3 (kynurenine-oxoglutarate transaminase. In one embodiment, the genetically engineered bacteria comprise one or more gene sequence(s) which encode BNA3 from *S. cerevisae*. In one embodiment, the genetically engineered bacteria comprise one or more gene sequence(s) which encode BNA2 in combination with one or more of ido1 and/or tdo2 and/or bna2. In one embodiment, the genetically engineered bacteria comprise one or more gene sequence(s) which encode BNA2 in combination with ido1. In one embodiment, the genetically engineered bacteria comprise one or more gene sequence(s) which encode BNA2 in combination with tdo2. In one embodiment, the genetically engineered bacteria comprise one or more gene sequence(s) which encode BNA2 in combination with bna2. In one embodiment, the genetically engineered bacteria comprise one or more gene sequence(s) which encode one or more of ido1 and/or tdo2 and/or bna2. In one embodiment, the genetically engineered bacteria comprise one or more gene sequence(s) which encode one or more of afmid and/or bna3. In one embodiment, the genetically engineered bacteria comprise one or more gene sequence(s) which encode one or more of ido1 and/or tdo2 and/or bna2, in combination with one or more of afmid and/or bna3.

In any of these embodiments, the genetically engineered bacteria which produce kynurenine from tryptophan also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce kynurenine from tryptophan also optionally comprise one or more gene sequence(s) which encode one or more transporter(s) as described herein, through which tryptophan can be imported. Optionally, in some embodiments, the genetically engineered bacteria which produce kynurenine from tryptophan also optionally comprise one or more gene sequence(s) which encode an exporter as described herein, which can export tryptophan or any of its metabolites.

Kynureninic Acid

In one embodiment, the genetically engineered bacteria comprise one or more gene sequence(s) which encode one or more tryptophan catabolism enzymes, which produce kynureninic acid from tryptophan. Non-limiting example of such gene sequence(s) are shown FIG. 41F and described elsewhere herein. In one embodiment, the genetically engineered bacteria comprise one or more gene sequence(s) which encode IDO1 (indoleamine 2,3-dioxygenase). In one embodiment, the genetically engineered bacteria comprise one or more gene sequence(s) which encode IDO1 from *Homo sapiens*. In one embodiment, the genetically engineered bacteria comprise one or more gene sequence(s) which encode TDO2 (tryptophan 2,3-dioxygenase). In one embodiment, the genetically engineered bacteria comprise one or more gene sequence(s) which encode TDO2 from *Homo sapiens*. In one embodiment, the genetically engineered bacteria comprise one or more gene sequence(s) which encode BNA2 (indoleamine 2,3-dioxygenase). In one embodiment, the genetically engineered bacteria comprise one or more gene sequence(s) which encode BNA2 from *S. cerevisiae*). In one embodiment, the genetically engineered bacteria comprise one or more gene sequence(s) which encode Afmid: Kynurenine formamidase. In one embodiment, the genetically engineered bacteria comprise one or more gene sequence(s) which encode Afmid: Kynurenine formamidase from mouse. In one embodiment, the genetically engineered bacteria comprise one or more gene sequence(s) which encode Afmid in combination with one or more of ido1 and/or tdo2 and/or bna2. In one embodiment, the genetically engineered bacteria comprise one or more gene sequence(s) which encode Afmid in combination with ido1. In one embodiment, the genetically engineered bacteria comprise one or more gene sequence(s) which encode BNA2 in combination with tdo2. In one embodiment, the genetically engineered bacteria comprise one or more gene sequence(s) which encode Afmid in combination with bna2. In one embodiment, the genetically engineered bacteria further comprise one or more gene sequence(s) which encode cclb1 and/or cclb2 and/or aadat and/or got2. In one embodiment, the genetically engineered bacteria comprise one or more gene sequence(s) which encode BNA3 (kynurenine-oxoglutarate transaminase). In one embodiment, the genetically engineered bacteria comprise one or more gene sequence(s) which encode BNA3 from *S. cerevisae*. In one embodiment, the genetically engineered bacteria comprise one or more gene sequence(s) which encode BNA2 in combination with one or more of ido1 and/or tdo2 and/or bna2. In one embodiment, the genetically engineered bacteria comprise one or more gene sequence(s) which encode BNA2 in combination with ido1. In one embodiment, the genetically engineered bacteria comprise one or more gene sequence(s) which encode BNA2 in combination with tdo2. In one embodiment, the genetically engineered bacteria comprise one or more gene sequence(s) which encode BNA2 in combination with bna2. In one embodiment, the genetically engineered bacteria further comprise one or more gene sequence(s) which encode cclb1 and/or cclb2 and/or aadat and/or got2. In one embodiment, the genetically engineered bacteria comprise one or more gene sequence(s) which encode one or more of ido1 and/or tdo2 and/or bna2.

In one embodiment, the genetically engineered bacteria comprise one or more gene sequence(s) which encode one or more of afmid and/or bna3. In one embodiment, the genetically engineered bacteria comprise one or more gene sequence(s) which encode one or more of ido1 and/or tdo2 and/or bna2, in combination with one or more of afmid and/or bna3. In one embodiment, the genetically engineered bacteria comprise one or more gene sequence(s) which encode GOT2 (Aspartate aminotransferase, mitochondrial). In one embodiment, the genetically engineered bacteria comprise one or more gene sequence(s) which encode GOT2 from *Homo sapiens*. In one embodiment, the genetically engineered bacteria comprise one or more gene sequence(s) which encode AADAT (Kynurenine/alpha-aminoadipate aminotransferase, mitochondrial). In one embodiment, the genetically engineered bacteria comprise one or more gene sequence(s) which encode AADAT from *Homo sapiens*. In one embodiment, the genetically engineered bacteria comprise one or more gene sequence(s) which encode CCLB1 (Kynurenine-oxoglutarate transaminase). In one embodiment, the genetically engineered bacteria comprise one or more gene sequence(s) which encode CCLB1 from *Homo sapiens*). In one embodiment, the genetically engineered bacteria comprise one or more gene sequence(s) which encode CCLB2 (kynurenine-oxoglutarate transaminase 3) In one embodiment, the genetically engineered bacteria comprise one or more gene sequence(s) which encode CCLB2 from *Homo sapiens*. In one embodiment, the genetically engineered bacteria comprise one or more gene sequence(s) which encode cclb1 and/or cclb2 and/or aadat and/or got2. In one embodiment, the genetically engineered bacteria comprise one or more gene sequence(s) which encode one or more of ido1 and/or tdo2 and/or bna2, in combination with one or more of afmid and/or bna3, and in combination with one or more of cclb1 and/or cclb2 and/or aadat and/or got2.

In any of these embodiments, the genetically engineered bacteria which produce kynurenic acid from tryptophan also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce kynurenic acid from tryptophan also optionally comprise one or more gene sequence(s) which encode one or more transporter(s) as described herein, through which tryptophan can be imported. Optionally, in some embodiments, the genetically engineered bacteria which produce kynurenic acid from tryptophan also optionally comprise one or more gene sequence(s) which encode an exporter as described herein, which can export tryptophan or any of its metabolites.

Indole

In one embodiment, the genetically engineered bacteria comprise one or more gene sequence(s) which encode one or more tryptophan catabolism enzymes, which produce indole from tryptophan. Non-limiting example of such gene sequence(s) are shown FIG. 41G and described elsewhere herein. In one embodiment, the genetically engineered bacteria comprise one or more gene sequence(s) which encode tnaA (tryptophanase). In one embodiment, the genetically engineered bacteria comprise one or more gene sequence(s) which encode tnaA from *E. coli*.

In any of these embodiments, the genetically engineered bacteria which produce indole from tryptophan also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce indole from tryptophan also optionally comprise one or more gene sequence(s) which encode one or more transporter(s) as described herein, through which tryptophan can be imported. Optionally, in some embodiments, the genetically engineered bacteria which produce indole from tryptophan also optionally comprise one or more gene sequence(s) which encode an exporter as described herein, which can export tryptophan or any of its metabolites.

Other Indole Metabolites

In one embodiment, the genetically engineered bacteria comprise one or more gene sequence(s) which encode one or more tryptophan catabolism enzymes, which produce indole-3-carbinol, indole-3-aldehyde, 3,3' diindolylmethane (DIM), indolo(3,2-b) carbazole (ICZ) from indole glucosinolate taken up through the diet. Non-limiting example of such gene sequence(s) are shown FIG. 41G and described elsewhere herein. In one embodiment, the genetically engineered bacteria comprise one or more gene sequence(s) which encode pne2 (myrosinase). In one embodiment, the genetically engineered bacteria comprise one or more gene sequence(s) which encode pne2 from *Arabidopsis thaliana*.

In any of these embodiments, the genetically engineered bacteria also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria also optionally comprise one or more gene sequence(s) which encode one or more transporter(s) as described herein, through which tryptophan can be imported. Optionally, in some embodiments, the genetically engineered bacteria also optionally comprise one or more gene sequence(s) which encode an exporter as described herein, which can export tryptophan or any of its metabolites.

Indole Acetic Acid

In one embodiment, the genetically engineered bacteria comprise one or more gene sequence(s) which encode one or more tryptophan catabolism enzymes, which produce indole-3-acetic acid.

Non-limiting example of such gene sequence(s) are shown in FIG. 42A, FIG. 42B, FIG. 42C, FIG. 42D, and FIG. 42E.

In one embodiment, the genetically engineered bacteria comprise one or more gene sequence(s) which encode aro9 (L-tryptophan aminotransferase). In one embodiment, the genetically engineered bacteria comprise one or more gene sequence(s) which encode aro9 from *S. cerevisae*). In one embodiment, the genetically engineered bacteria comprise one or more gene sequence(s) which encode aspC (aspartate aminotransferase), In one embodiment, the genetically engineered bacteria comprise one or more gene sequence(s) which encode aspC from *E. coli*. In one embodiment, the genetically engineered bacteria comprise one or more gene sequence(s) which encode taa1 (L-tryptophan-pyruvate aminotransferase. In one embodiment, the genetically engineered bacteria comprise one or more gene sequence(s) which encode taa1 from *Arabidopsis thaliana*). In one embodiment, the genetically engineered bacteria comprise one or more gene sequence(s) which encode staO (L-tryptophan oxidase). In one embodiment, the genetically engineered bacteria comprise one or more gene sequence(s) which encode staO from *streptomyces* sp. TP-A0274). In one embodiment, the genetically engineered bacteria comprise one or more gene sequence(s) which encode trpDH (Tryptophan dehydrogenase). In one embodiment, the genetically engineered bacteria comprise one or more gene sequence(s) which encode trpDH from *Nostoc punctiforme* NIES-2108). In one embodiment, the genetically engineered bacteria comprise one or more gene sequence(s) which encode iad1 (Indole-3-acetaldehyde dehydrogenase). In one embodiment, the genetically engineered bacteria comprise one or more gene sequence(s) which encode iad1 from *Ustilago maydis*. In one embodiment, the genetically engineered bacteria comprise one or more gene sequence(s) which encode AAO1 (Indole-3-acetaldehyde oxidase). In one embodiment, the genetically engineered bacteria comprise one or more gene sequence(s) which encode AAO1 from *Arabidopsis thaliana*. In one embodiment, the genetically engineered bacteria comprise one or more gene sequence(s) which encode ipdC (Indole-3-pyruvate decarboxylase, e.g., from *Enterobacter cloacae*). In one embodiment, the genetically engineered bacteria comprise one or more gene sequence(s) which encode ipdC (Indole-3-pyruvate decarboxylase, e.g., from *Enterobacter cloacae*) in combination with one or more sequences encoding enzymes selected from aro9 and/or aspC and/or taa1 and/or staO and/or trpDH. In one embodiment, the genetically engineered bacteria comprise one or more gene sequence(s) which encode ipdC (Indole-3-pyruvate decarboxylase, e.g., from *Enterobacter cloacae*) in combination with one or more sequences encoding enzymes selected from iad1 and/or aao1. In one embodiment, the genetically engineered bacteria comprise one or more gene sequence(s) which encode ipdC (Indole-3-pyruvate decarboxylase, e.g., from *Enterobacter cloacae*) in combination with one or more sequences encoding enzymes selected from aro9 and/or aspC and/or taa1 and/or staO and in combination with one or more sequences encoding enzymes selected from iad1 and/or aao1 (see, e.g., FIG. 42A).

Figure 42A:
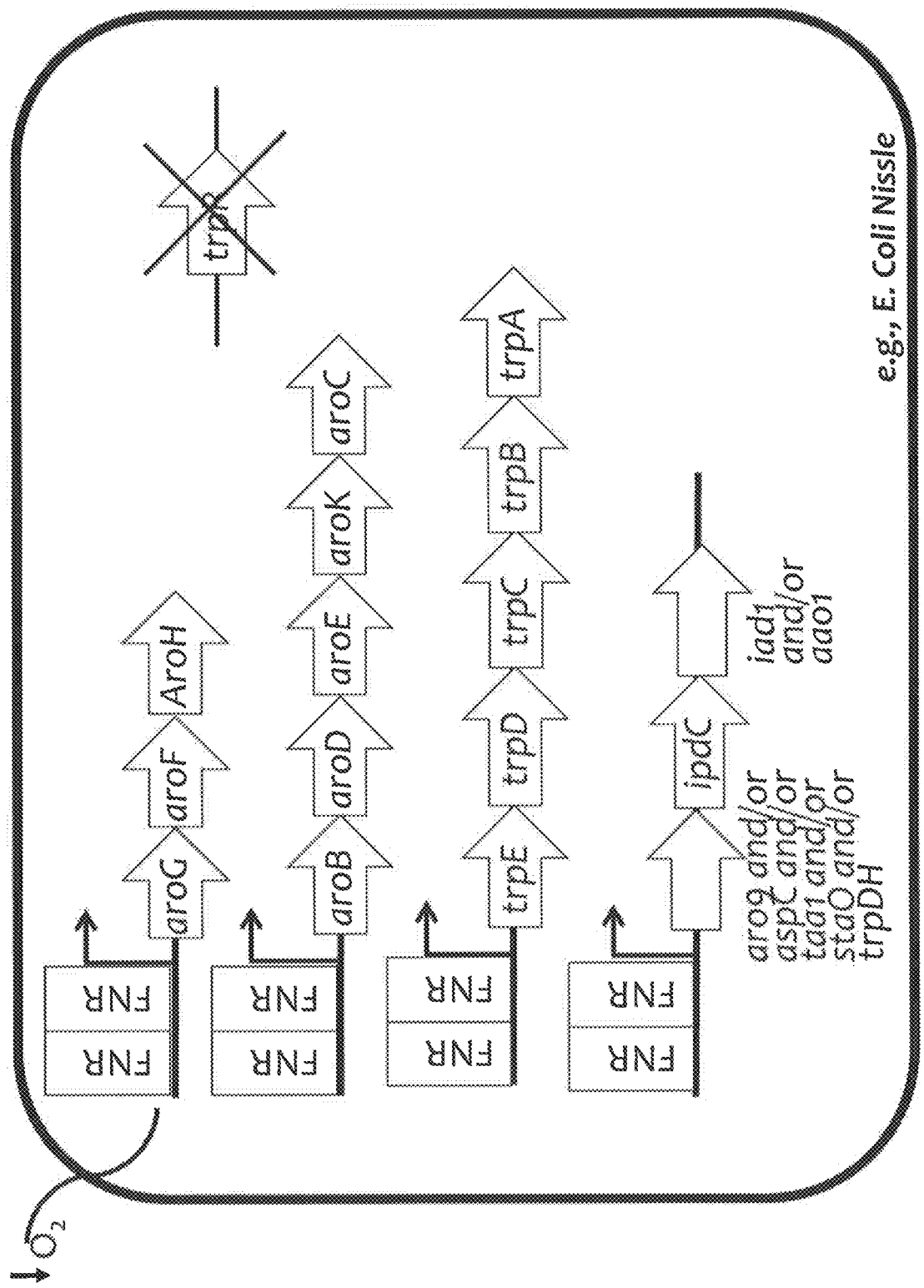
FIG. 42A, FIG. 42B, FIG. 42C, FIG. 42D, and FIG. 42E depict schematics of exemplary embodiments of the disclosure, in which the genetically engineered bacteria convert tryptophan into indole-3-acetic acid.
Figure 42B:
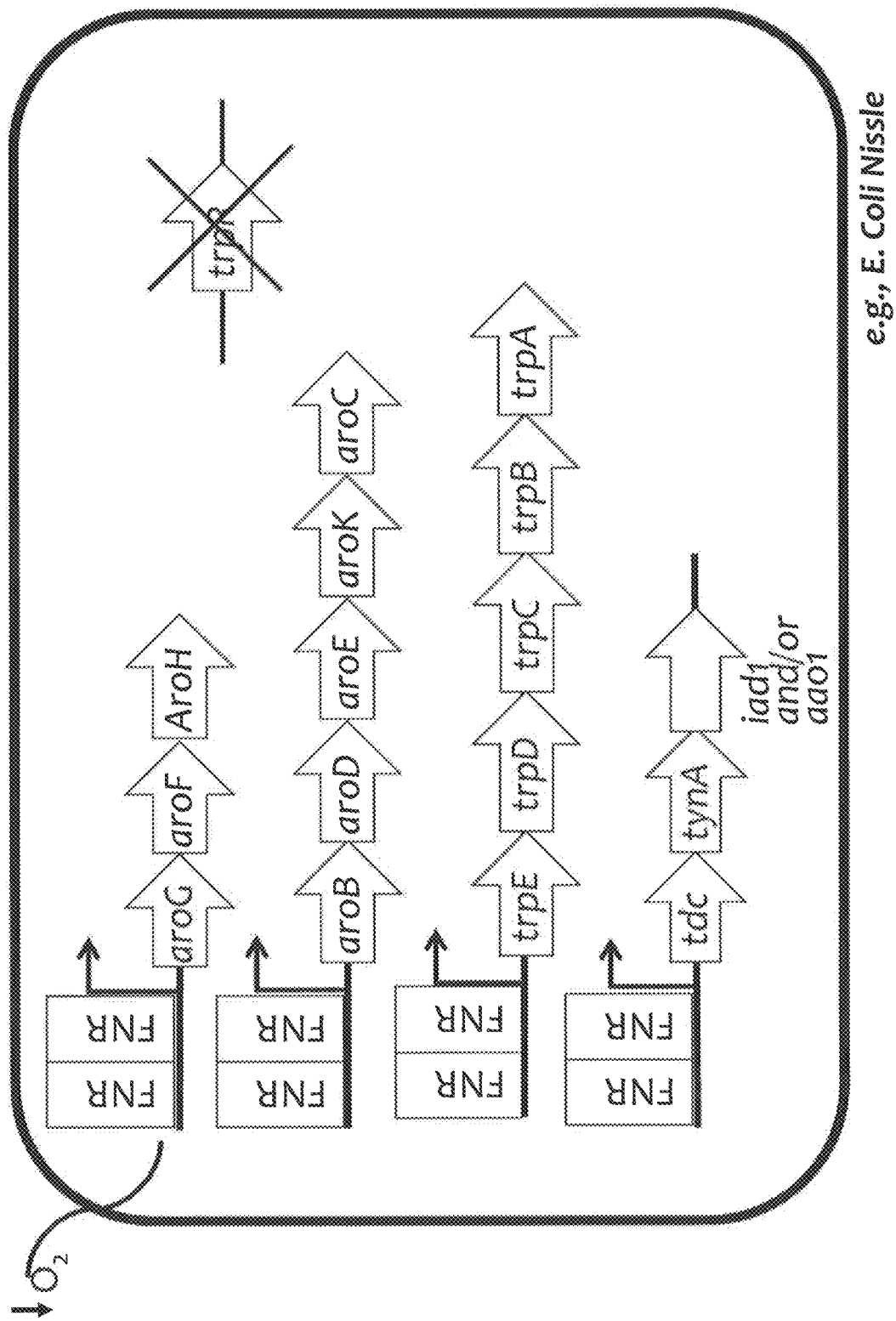

Another non-limiting example of gene sequence(s) for the production of acetic acid are shown in FIG. 42B. In one embodiment, the genetically engineered bacteria comprise one or more gene sequence(s) which encode tdc (Tryptophan decarboxylase). In one embodiment, the genetically engineered bacteria comprise one or more gene sequence(s) which encode tdc from *Catharanthus roseus*). In one embodiment, the genetically engineered bacteria comprise one or more gene sequence(s) which encode tynA (Monoamine oxidase). In one embodiment, the genetically engineered bacteria comprise one or more gene sequence(s) which encode tynA from *E. coli*). In one embodiment, the genetically engineered bacteria comprise one or more gene sequence(s) which encode iad1 (Indole-3-acetaldehyde dehydrogenase). In one embodiment, the genetically engineered bacteria comprise one or more gene sequence(s) which encode iad1 from *Ustilago maydis*). In one embodiment, the genetically engineered bacteria comprise one or more gene sequence(s) which encode AAO1 (Indole-3-acetaldehyde oxidase). In one embodiment, the genetically engineered bacteria comprise one or more gene sequence(s) which encode AAO1 from *Arabidopsis thaliana*). In one embodiment, the genetically engineered bacteria comprise one or more gene sequence(s) which encode tdc and tynA. In one embodiment, the genetically engineered bacteria comprise one or more gene sequence(s) which encode tdc and one or more sequence(s) selected from iad1 and/or aao1. In one embodiment, the genetically engineered bacteria comprise one or more gene sequence(s) which encode tynA and one or more sequence(s) selected from iad1 and/or aao1. In one embodiment, the genetically engineered bacteria comprise one or more gene sequence(s) which encode tdc and tynA and one or more sequence(s) selected from iad1 and/or aao1.

Figure 45D:
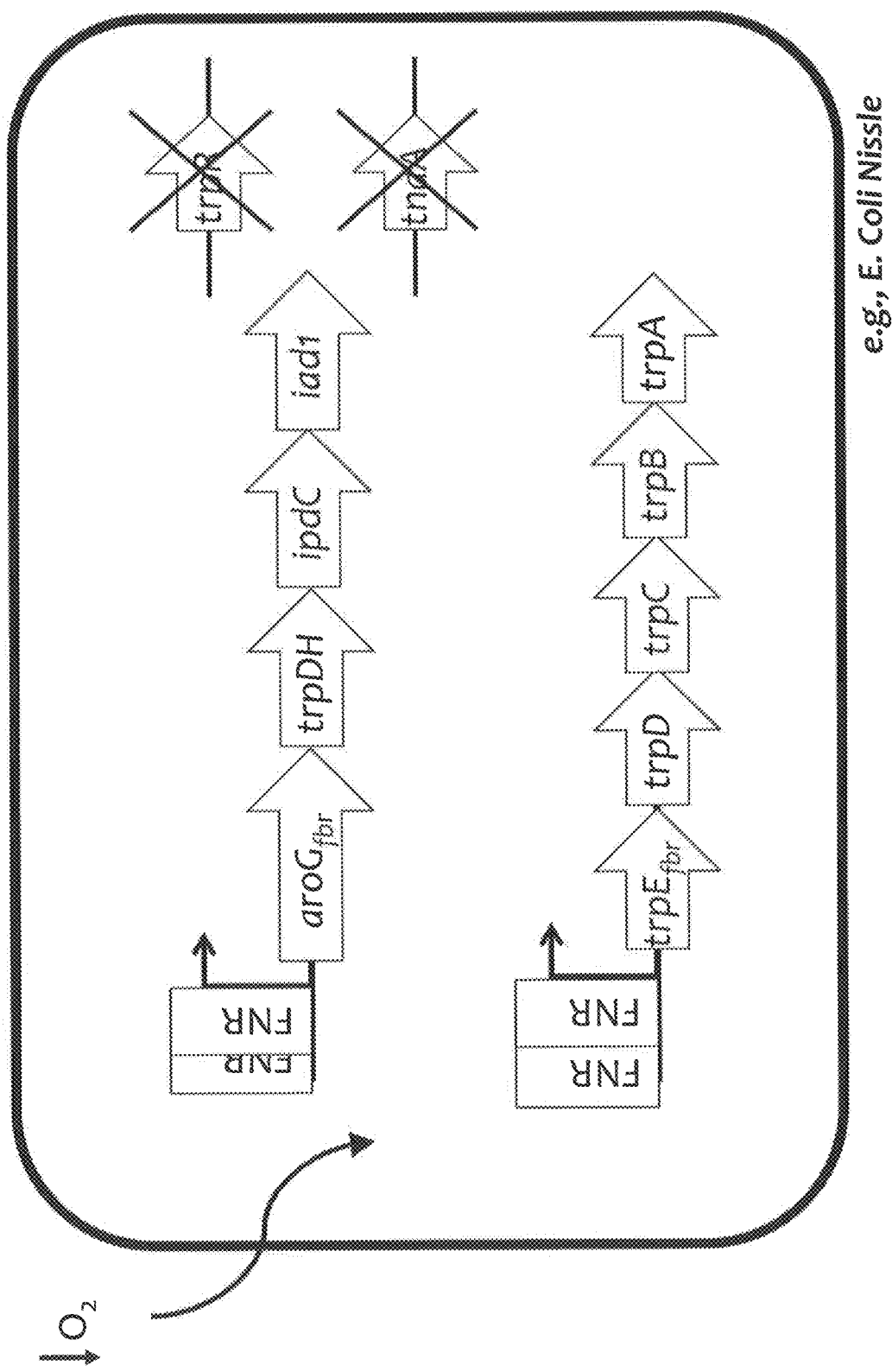

Another non-limiting example of gene sequence(s) for the production of acetic acid are shown in FIG. 45D. In one embodiment, the genetically engineered bacteria comprise one or more gene sequence(s) which encode trpDH (Tryptophan dehydrogenase). In one embodiment, the genetically engineered bacteria comprise one or more gene sequence(s) which encode trpDH from *Nostoc punctiforme* NIES-2108. In one embodiment, the genetically engineered bacteria comprise one or more gene sequence(s) which encode ipdC (Indole-3-pyruvate decarboxylase, e.g., from *Enterobacter cloacae*). In one embodiment, the genetically engineered bacteria comprise one or more gene sequence(s) which encode iad1 (Indole-3-acetaldehyde dehydrogenase). In one embodiment, the genetically engineered bacteria comprise one or more gene sequence(s) which encode iad1 from *Ustilago maydis*. In one embodiment, the genetically engineered bacteria comprise one or more gene sequence(s) which encode one or more of trpDH and/or ipdC and/or iad1. In one embodiment, the genetically engineered bacteria comprise one or more gene sequence(s) which encode one or more of trpDH and ipdC and iad1.

Figure 42C:
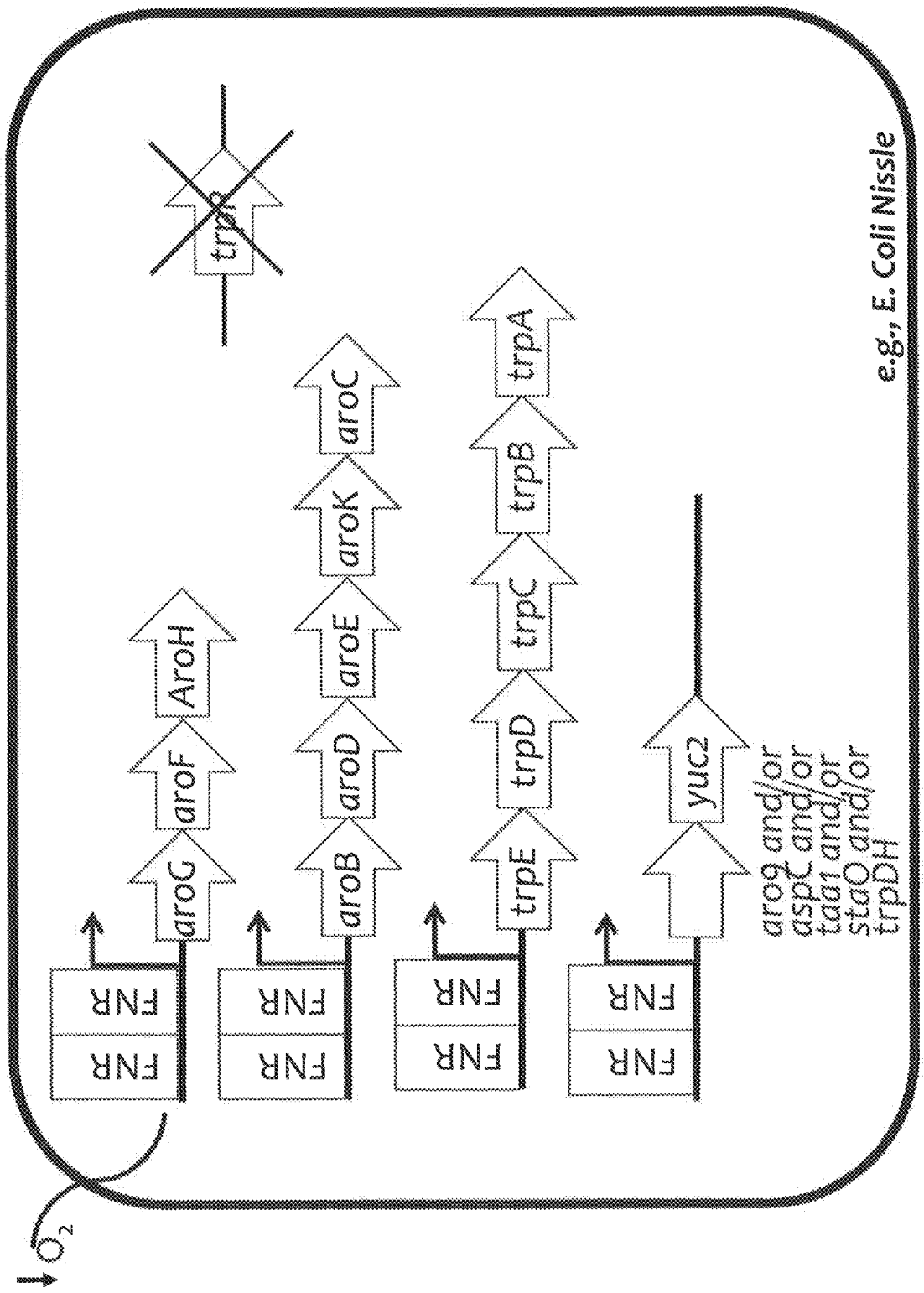

Another non-limiting example of gene sequence(s) for the production of acetic acid are shown in FIG. 42C. In one embodiment, the genetically engineered bacteria comprise one or more gene sequence(s) which encode yuc2 (indole-3-pyruvate monooxygenase). In one embodiment, the genetically engineered bacteria comprise one or more gene sequence(s) which encode yuc2 from *Enterobacter cloacae*. In one embodiment, the genetically engineered bacteria comprise one or more gene sequence(s) which encode aro9 (L-tryptophan aminotransferase). In one embodiment, the (L-tryptophan aminotransferase is from *S. cerevisiae*. In one embodiment, the genetically engineered bacteria comprise one or more gene sequence(s) which encode aro9 and yuc2. In one embodiment, the genetically engineered bacteria comprise one or more gene sequence(s) which encode aspC (aspartate aminotransferase. In one embodiment, the genetically engineered bacteria comprise one or more gene sequence(s) which encode aspC from *E. coli*. In one embodiment, the genetically engineered bacteria comprise one or more gene sequence(s) which encode aspC and yuc2. In one embodiment, the genetically engineered bacteria comprise one or more gene sequence(s) which encode taa1 (L-tryptophan-pyruvate aminotransferase, In one embodiment, the genetically engineered bacteria comprise one or more gene sequence(s) which encode taa1 from *Arabidopsis thaliana*. In one embodiment, the genetically engineered bacteria comprise one or more gene sequence(s) which encode taa1 and yuc2. In one embodiment, the genetically engineered bacteria comprise one or more gene sequence(s) which encode staO (L-tryptophan oxidase). In one embodiment, the genetically engineered bacteria comprise one or more gene sequence(s) which encode staO from *streptomyces* sp. TP-A0274. In one embodiment, the genetically engineered bacteria comprise one or more gene sequence(s) which encode staO and yuc2. In one embodiment, the genetically engineered bacteria comprise one or more gene sequence(s) which encode trpDH (Tryptophan dehydrogenase). In one embodiment, the genetically engineered bacteria comprise one or more gene sequence(s) which encode trpDH from *Nostoc punctiforme* NIES-2108. In one embodiment, the genetically engineered bacteria comprise one or more gene sequence(s) which encode trpDH and yuc2. In one embodiment, the genetically engineered bacteria comprise one or more gene sequence(s) which encode one or more of aro9 or aspC or taa1 or staO or trpDH. In one embodiment, the genetically engineered bacteria comprise one or more gene sequence(s) which encode one or more of aro9 or aspC or taa1 or staO or trpDH and yuc2.

Figure 42D:
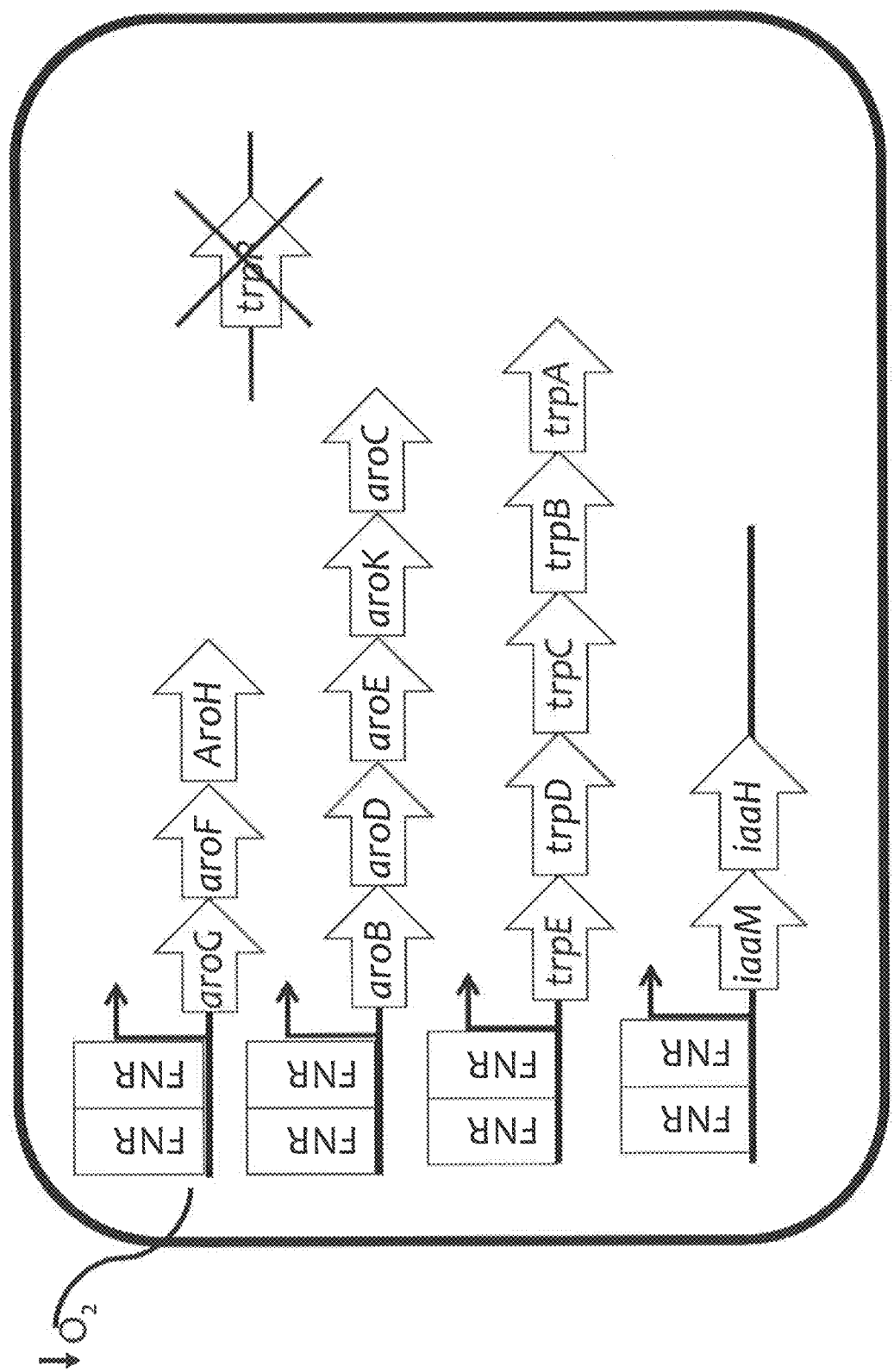

Another non-limiting example of gene sequence(s) for the production of acetic acid are shown in FIG. 42D. In one embodiment, the genetically engineered bacteria comprise one or more gene sequence(s) which encode IaaM (Tryptophan 2-monooxygenase). In one embodiment, the genetically engineered bacteria comprise one or more gene sequence(s) which encode IaaM from *Pseudomonas savastanoi*). In one embodiment, the genetically engineered bacteria comprise one or more gene sequence(s) which encode iaaH (Indoleacetamide hydrolase). In one embodiment, the genetically engineered bacteria comprise one or more gene sequence(s) which encode iaaH from *Pseudomonas savastanoi*). In one embodiment, the genetically engineered bacteria comprise one or more gene sequence(s) which encode IaaM and iaaH.

Figure 42E:
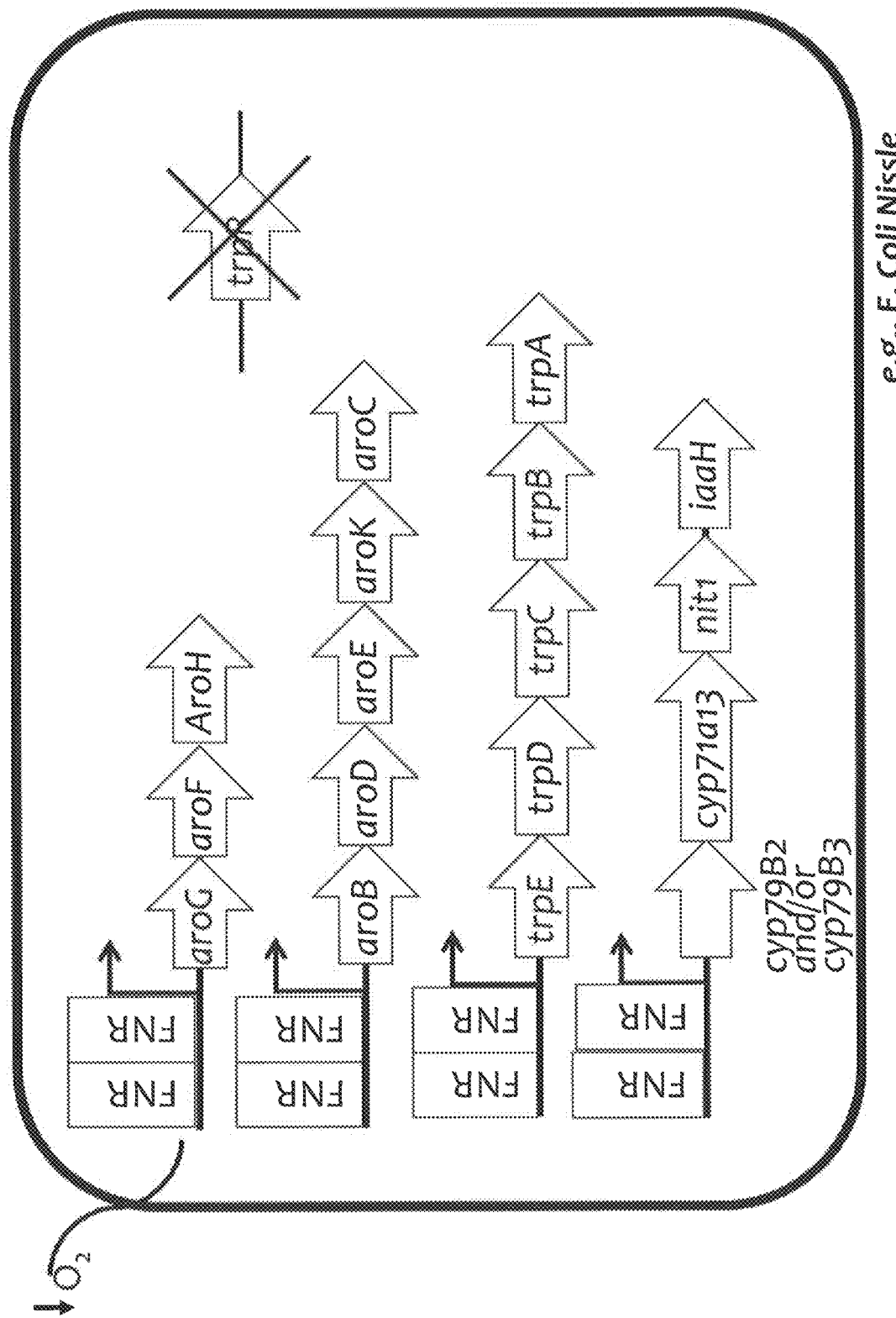

Another non-limiting example of gene sequence(s) for the production of acetic acid are shown in FIG. 42E. In one embodiment, the genetically engineered bacteria comprise one or more gene sequence(s) which encode cyp71a13 (indoleacetaldoxime dehydratase). In one embodiment, the genetically engineered bacteria comprise one or more gene sequence(s) which encode cyp71a13 from *Arabidopis thaliana*. In one embodiment, the genetically engineered bacteria comprise one or more gene sequence(s) which encode nit1 (Nitrilase). In one embodiment, the genetically engineered bacteria comprise one or more gene sequence(s) which encode nit1 from *Arabidopsis thaliana*. In one embodiment, the genetically engineered bacteria comprise one or more gene sequence(s) which encode iaaH (Indoleacetamide hydrolase). In one embodiment, the genetically engineered bacteria comprise one or more gene sequence(s) which encode iaaH from *Pseudomonas savastanoi*). In one embodiment, the genetically engineered bacteria comprise one or more gene sequence(s) which encode cyp79B2 (tryptophan N-monooxygenase). In one embodiment, the genetically engineered bacteria comprise one or more gene sequence(s) which encode cyp79B2 from *Arabidopsis thaliana*. In one embodiment, the genetically engineered bacteria comprise one or more gene sequence(s) which encode cyp79B2 and cyp71a13. In one embodiment, the genetically engineered bacteria comprise one or more gene sequence(s) which encode cyp79B2 from *Arabidopsis thaliana*. In one embodiment, the genetically engineered bacteria comprise one or more gene sequence(s) which encode cyp79B2 and nit1 and/or iaaH. In one embodiment, the genetically engineered bacteria comprise one or more gene sequence(s) which encode cyp79B3 (tryptophan N-monooxygenase). In one embodiment, the genetically engineered bacteria comprise one or more gene sequence(s) which encode cyp79B3 from *Arabidopsis thaliana*. In one embodiment, the genetically engineered bacteria comprise one or more gene sequence(s) which encode cyp79B3 and cyp71a13. In one embodiment, the genetically engineered bacteria comprise one or more gene sequence(s) which encode cyp79B3 and cyp71a13 and nit1 and/or iaaH. In one embodiment, the genetically engineered bacteria comprise one or more gene sequence(s) which encode cyp79B3, cyp79B2 and cyp71a13. In one embodiment, the genetically engineered bacteria comprise one or more gene sequence(s) which encode cyp79B3, cyp79B2 and cyp71a13, and nit1 and/or iaaH. In one embodiment, the genetically engineered bacteria comprise one or more gene sequence(s) which encode cyp79B3 from *Arabidopsis thaliana*. In one embodiment, the genetically engineered bacteria comprise one or more gene sequence(s) which encode cyp79B3 and cyp71a13 and nit1 and iaaH. In one embodiment, the genetically engineered bacteria comprise one or more gene sequence(s) which encode cyp79B3, cyp79B2 and cyp71a13 and nit1 and iaaH.

In any of these embodiments, the genetically engineered bacteria which produce indole acetic acid also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce indole acetic acid also optionally comprise one or more gene sequence(s) which encode one or more transporter(s) as described herein, through which tryptophan can be imported. Optionally, in some embodiments, the genetically engineered bacteria which produce indole acetic acid also optionally comprise one or more gene sequence(s) which encode an exporter as described herein, which can export tryptophan or any of its metabolites.

Indole-3-propionic acid (IPA)

Figure 43A:
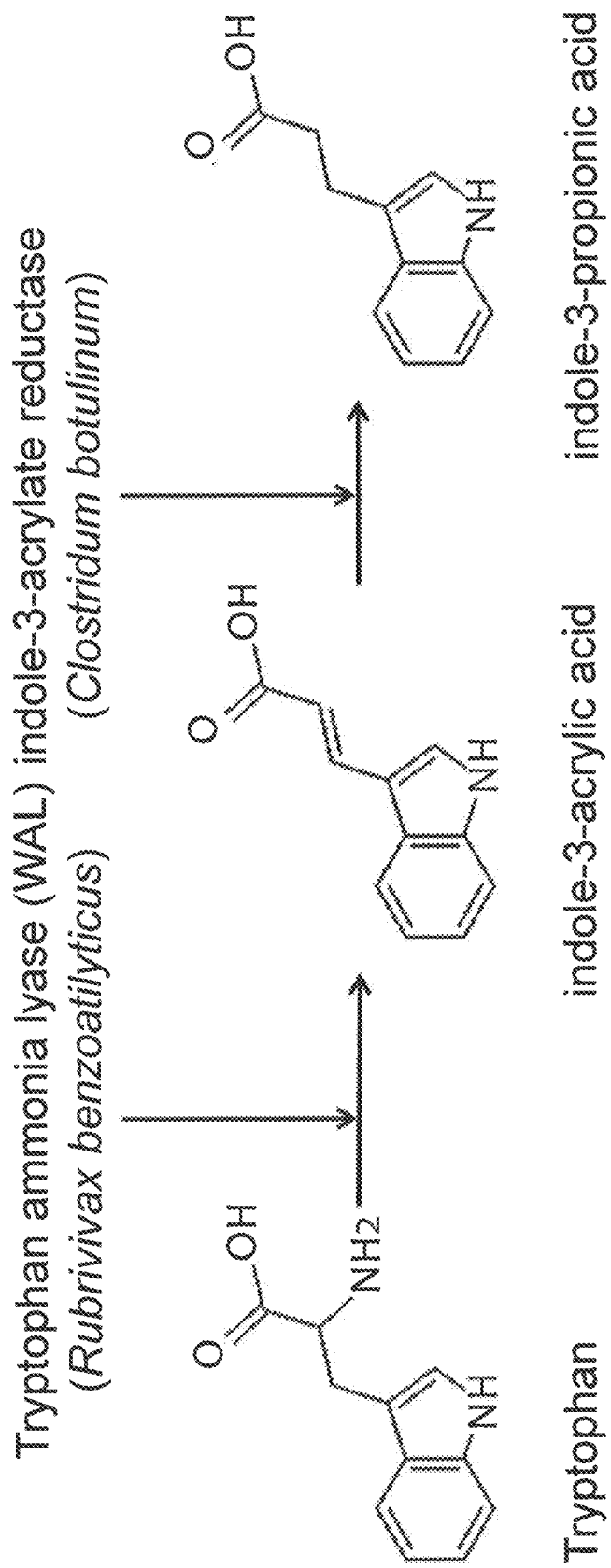
FIG. 43A and FIG. 43B depict schematics of circuits for the production of indole metabolites.
Figure 43B:
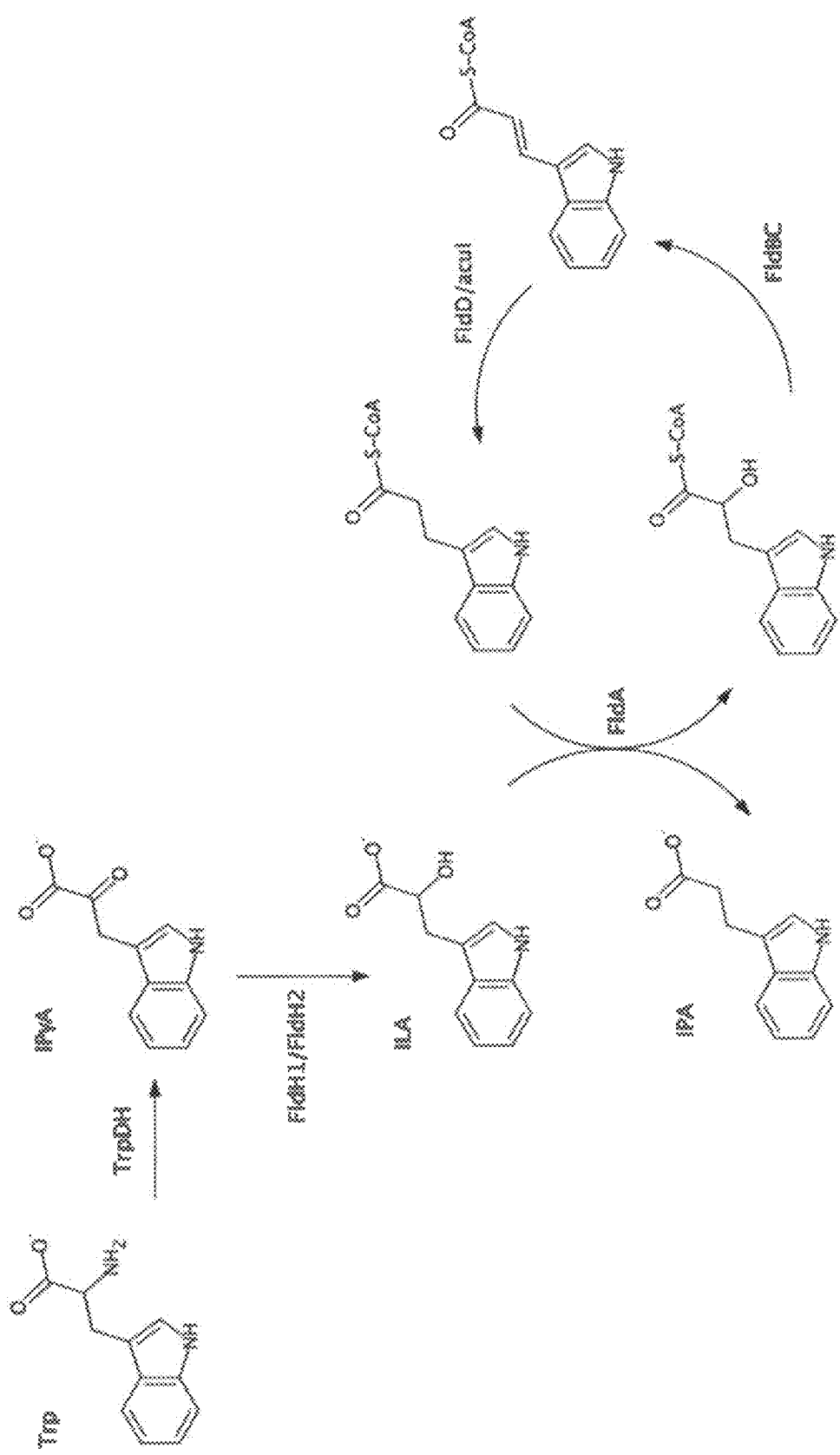

In one embodiment, the genetically engineered bacteria comprise one or more gene sequence(s) which encode one or more tryptophan catabolism enzymes, which produce indole-3-propionic acid from tryptophan. FIG. 43A and FIG. 43B depict schematics exemplary circuits for the production of indole-3-propionic acid.

In some embodiments, the genetically engineered bacteria comprise one or more gene sequences encoding tryptophan ammonia lyase. In some embodiments, the genetically engineered bacteria comprise one or more gene sequences encoding tryptophan ammonia lyase from *Rubrivivax benzoatilyticus*. In some embodiments, the genetically engineered bacteria comprise one or more gene sequences encoding indole-3-acrylate reductase. In some embodiments, the genetically engineered bacteria comprise one or more gene sequences encoding indole-3-acrylate reductase from *Clostridum botulinum*. In some embodiments, the genetically engineered bacteria comprise one or more gene sequences encoding a tryptophan ammonia lyase and an indole-3-acrylate reductase.

Figure 45E:
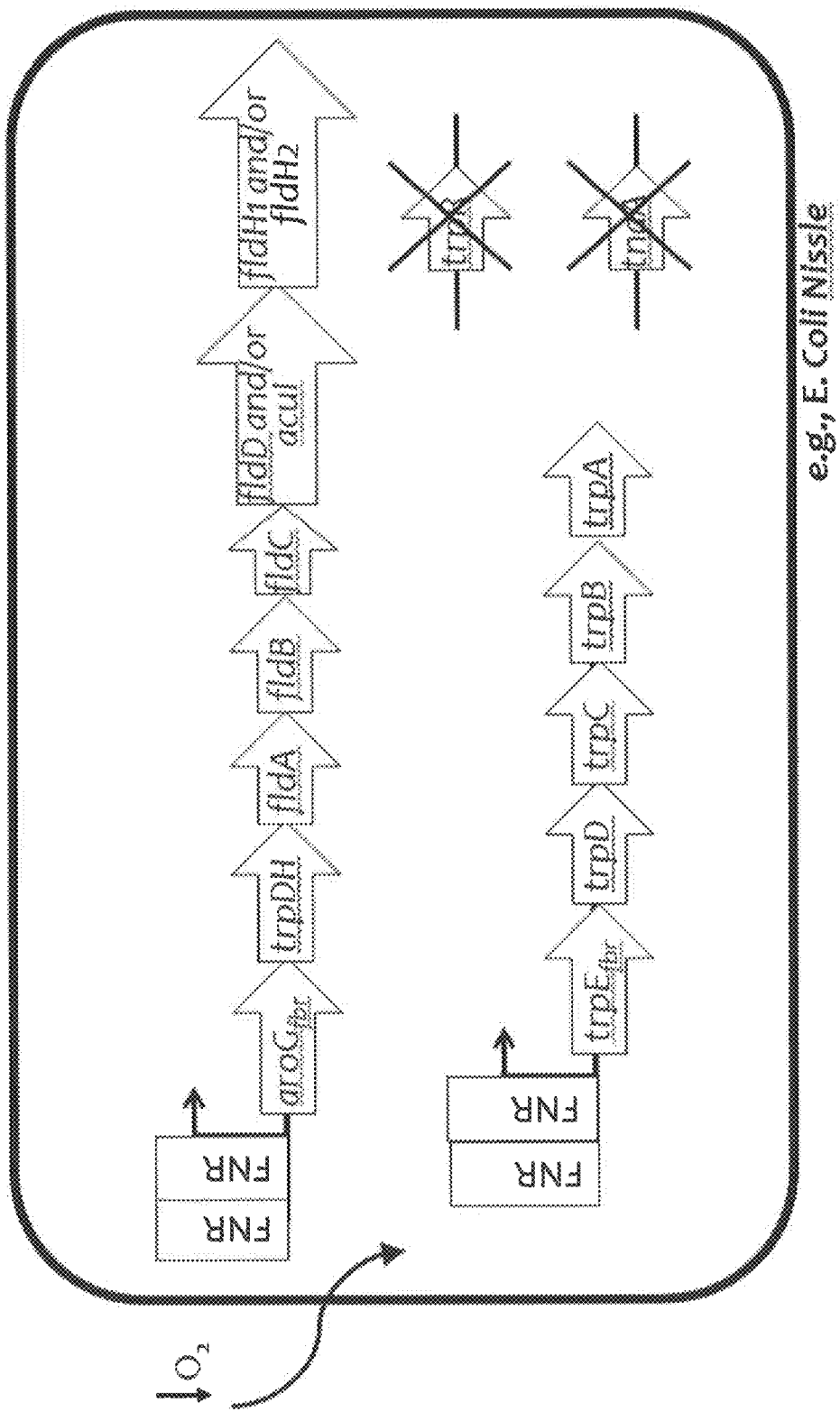
Figure 46A:
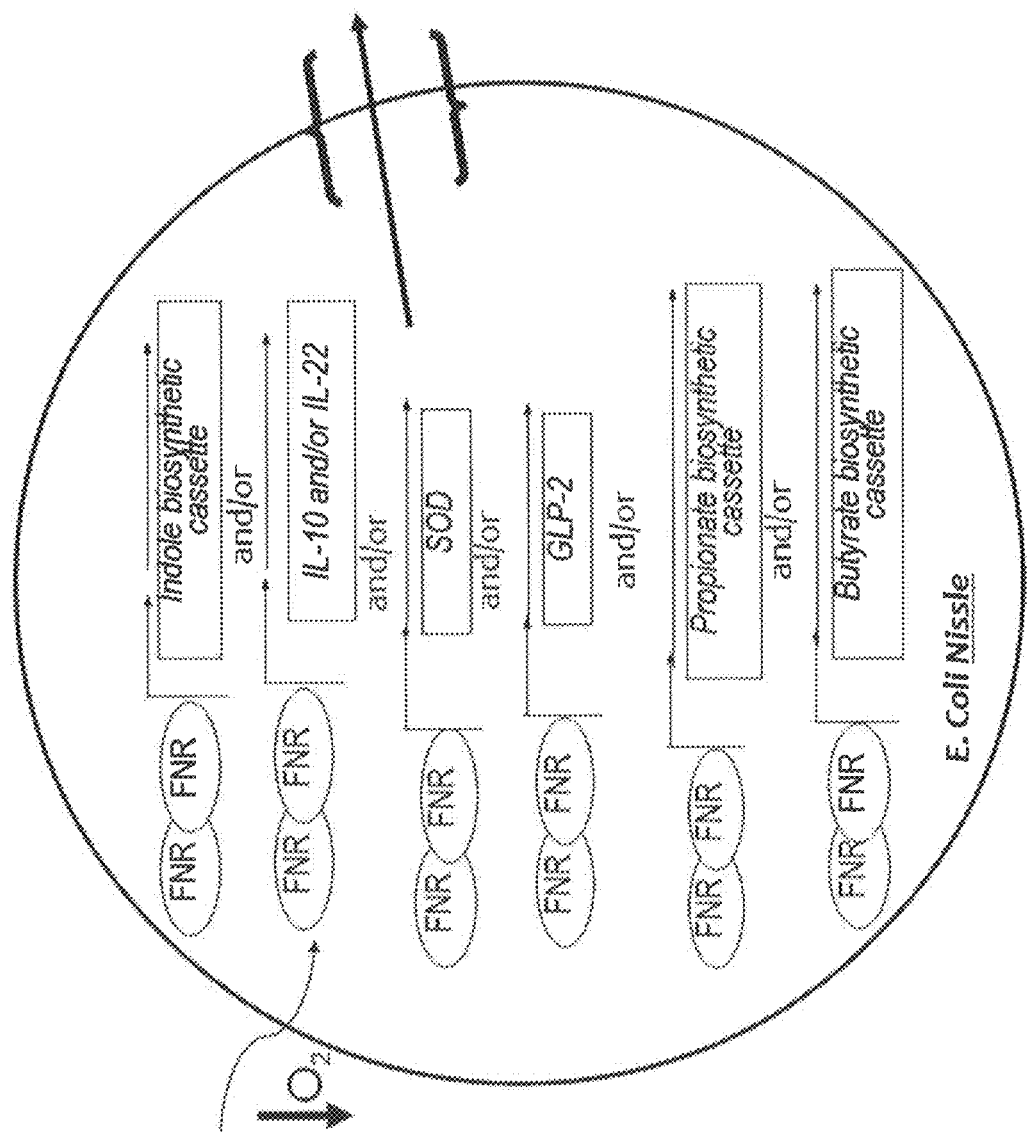
FIG. 46A, FIG. 46B, FIG. 46C, FIG. 46D, FIG. 46E depict schematics of non-limiting examples of genetically engineered bacteria of the disclosure which comprises one or more gene sequence(s) and/or gene cassette(s) as described herein.
Figure 46B:
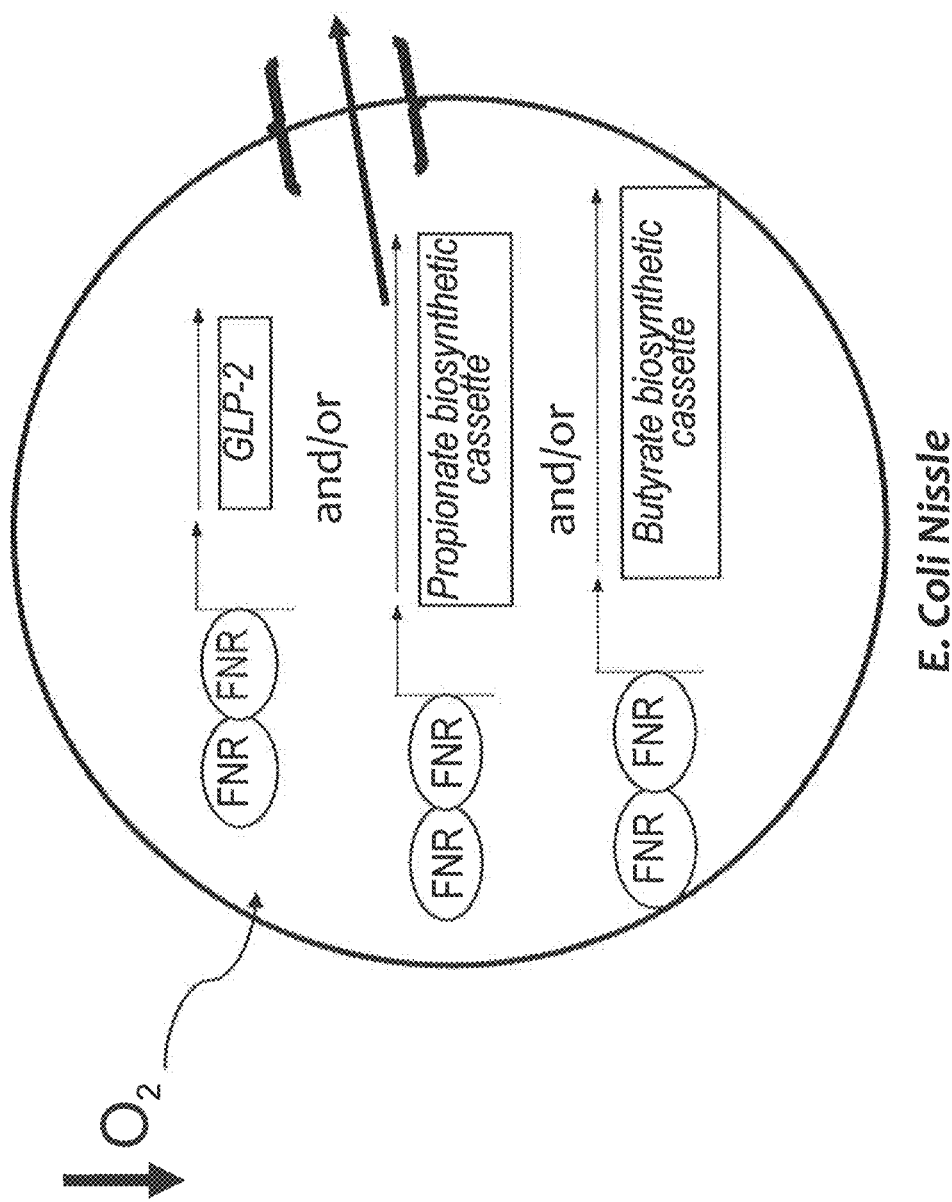
Figure 46C:
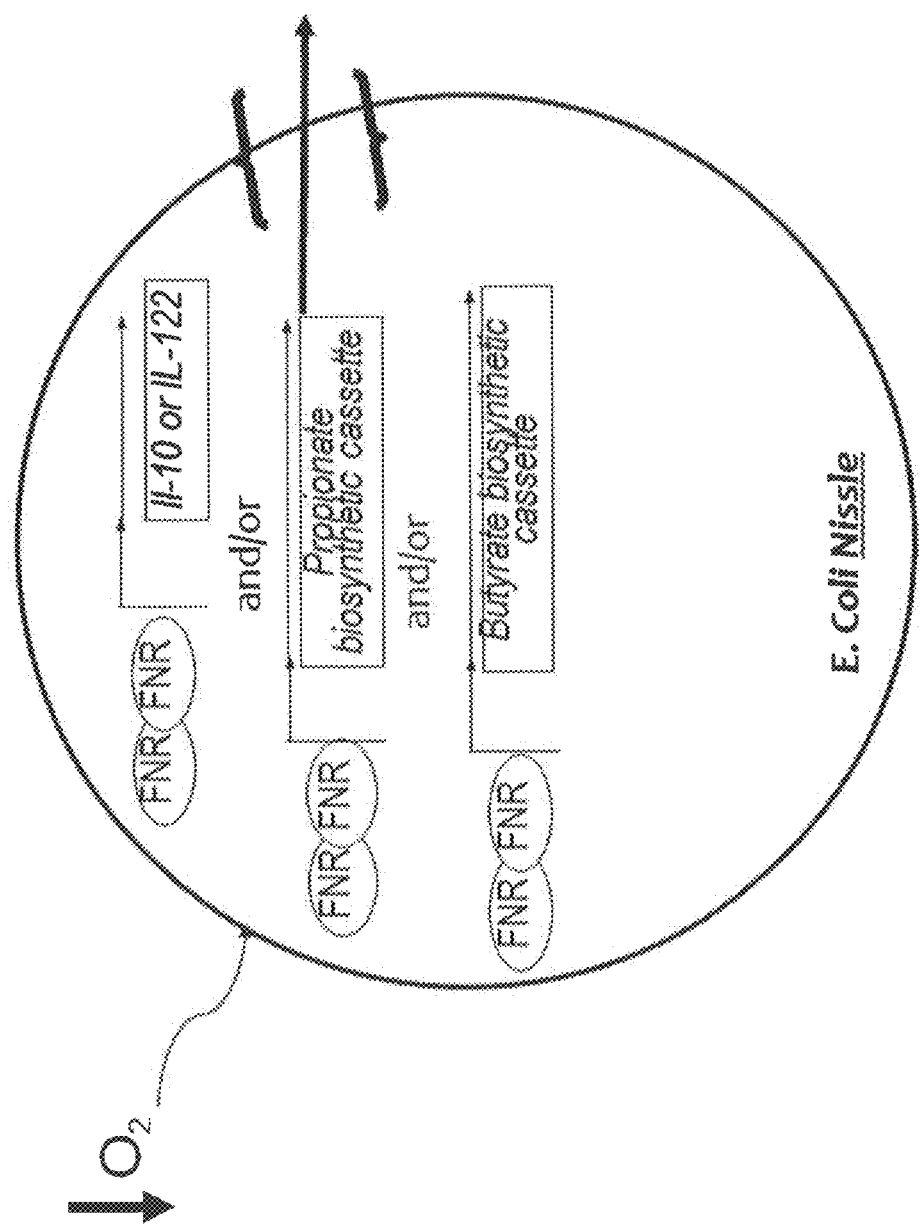
Figure 46D:
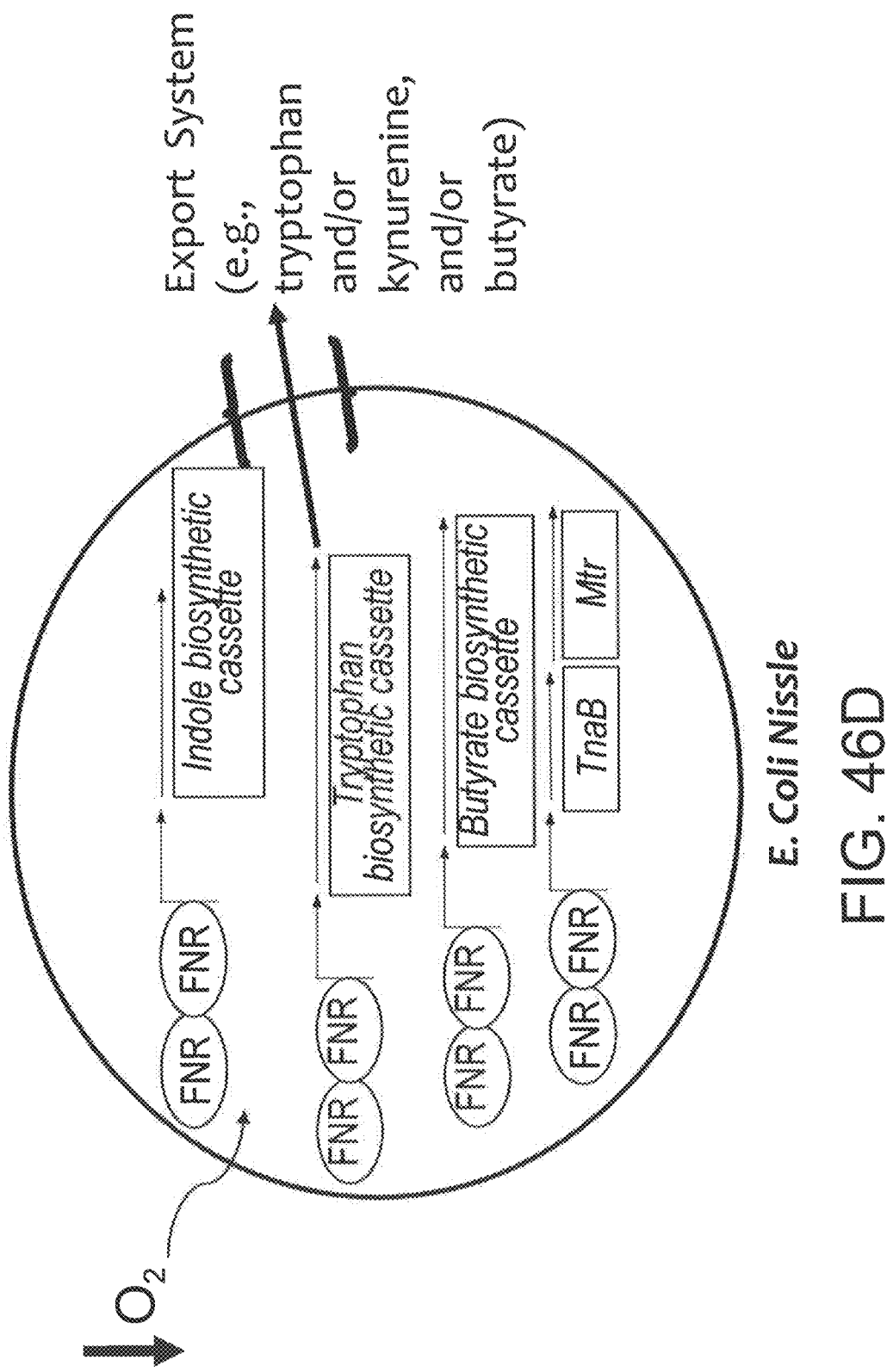
Figure 46E:
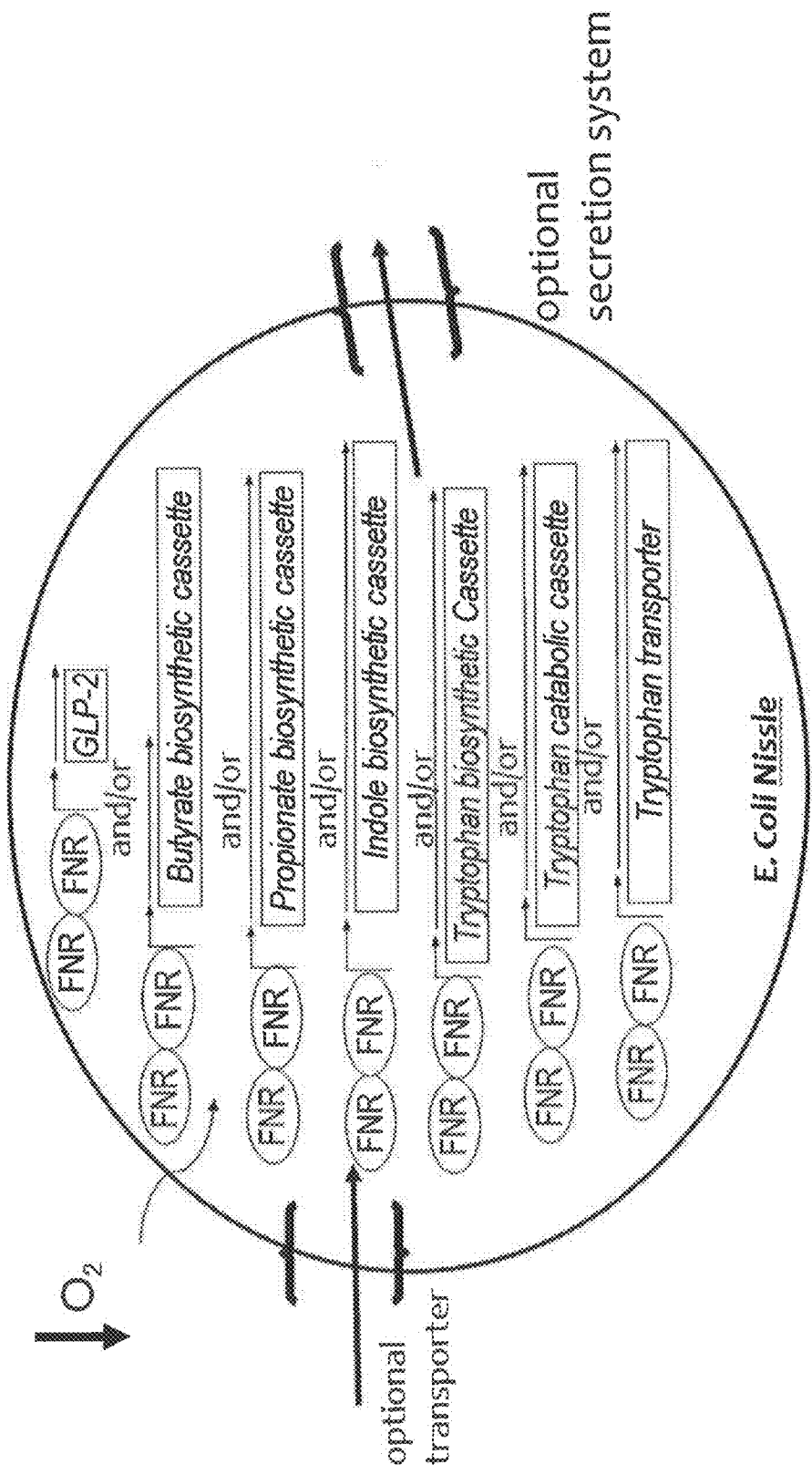

FIG. 45E depicts another non-limiting example of an indole-3-propionate-producing strain. In some embodiments, the genetically engineered bacteria comprise one or more gene sequences encoding trpDH (Tryptophan dehydrogenase). In some embodiments, the genetically engineered bacteria comprise one or more gene sequences encoding trpDH from *Nostoc punctiforme* NIES-2108. In some embodiments, the genetically engineered bacteria comprise one or more gene sequences encoding fldA (indole-3-propionyl-CoA:indole-3-lactate CoA transferase). In some embodiments, the genetically engineered bacteria comprise one or more gene sequences encoding fldA from *Clostridium sporogenes*. In some embodiments, the genetically engineered bacteria comprise one or more gene sequences encoding fldB and fldC (indole-3-lactate dehydratase). In some embodiments, the genetically engineered bacteria comprise one or more gene sequences encoding fldB and fldC *Clostridium sporogenes*. In some embodiments, the genetically engineered bacteria comprise one or more gene sequences encoding fldD (indole-3-acrylyl-CoA reductase). In some embodiments, the genetically engineered bacteria comprise one or more gene sequences encoding fldD from *Clostridium sporogenes*. In some embodiments, the genetically engineered bacteria comprise one or more gene sequences encoding AcuI (acrylyl-CoA reductase). In some embodiments, the genetically engineered bacteria comprise one or more gene sequences encoding AcuI from *Rhodobacter sphaeroides*. In some embodiments, the genetically engineered bacteria comprise one or more gene sequences encoding fldH1 (3-lactate dehydrogenase 1). In some embodiments, the genetically engineered bacteria comprise one or more gene sequences encoding fldH1 from *Clostridium sporogenes*. In some embodiments, the genetically engineered bacteria comprise one or more gene sequences encoding fldH2 (indole-3-lactate dehydrogenase 2). In some embodiments, the genetically engineered bacteria comprise one or more gene sequences encoding fldH2 from *Clostridium sporogenes*). In some embodiments, the genetically engineered bacteria comprise one or more gene sequences encoding trpDH and/or fldA and/or fldB and/or flD and/or fldH1. In some embodiments, the genetically engineered bacteria comprise one or more gene sequences encoding trpDH and/or fldA and/or fldB and/or flD and/or fldH2. In some embodiments, the genetically engineered bacteria comprise one or more gene sequences encoding trpDH and/or fldA and/or fldB and/or acuI and/or fldH1. In some embodiments, the genetically engineered bacteria comprise one or more gene sequences encoding trpDH and/or fldA and/or fldB and/or acuI and/or fldH2. In some embodiments, the genetically engineered bacteria comprise one or more gene sequences encoding trpDH and fldA and fldB and flD and fldH1. In some embodiments, the genetically engineered bacteria comprise one or more gene sequences encoding trpDH and fldA and fldB and flD and fldH2. In some embodiments, the genetically engineered bacteria comprise one or more gene sequences encoding trpDH and fldA and fldB and acuI and fldH1. In some embodiments, the genetically engineered bacteria comprise one or more gene sequences encoding trpDH and fldA and fldB and acuI and fldH2.

In any of these embodiments, the genetically engineered bacteria which produce indole-3-propionic acid also optionally comprise one or more gene sequence(s) comprising one or more enzymes for tryptophan production, and gene deletions/or mutations as depicted and described in FIG. 39, FIG. 45A and/or FIG. 45B and described elsewhere herein. In some embodiments, the genetically engineered bacteria which produce indole-3-propionic acid also optionally comprise one or more gene sequence(s) which encode one or more transporter(s) as described herein, through which tryptophan can be imported. Optionally, in some embodiments, the genetically engineered bacteria which produce indole-3-propionic acid also optionally comprise one or more gene sequence(s) which encode an exporter as described herein, which can export tryptophan or any of its metabolites. In certain embodiments, the genetically engineered bacteria comprise one or more gene sequence(s) encoding one or more enzymes for the production of tryptophan metabolites. In some embodiments, the genetically engineered bacteria comprise one or more gene sequence(s) encoding 1, 2, 3, 4, 5, 6, 7, 8, 9, 10 different tryptophan metabolites. In certain embodiments the bacteria comprise one or more gene sequence(s) encoding one or more enzymes for the production of tryptophan metabolites selected from tryptamine and/or indole-3 acetaladehyde, indole-3acetonitrile, kynurenine, kynurenic acid, indole, indole acetic acid FICZ, indole-3-propionic acid.

In any of these embodiments the expression of the gene sequences for the production of the indole and other tryptophan metabolites, including, but not limited to, tryptamine and/or indole-3 acetaladehyde, indole-3acetonitrile, kynurenine, kynurenic acid, indole, indole acetic acid FICZ, indole-3-propionic acid is under the control of an inducible promoter. Exemplary inducible promoters which may control the expression of the biosynthetic cassettes include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline.

Exemplary circuits for the production of indole metabolites/derivatives are shown in FIG. 41A through FIG. 41H, FIG. 42A through FIG. 42E, and FIG. 43A though FIG. 43B, and FIG. 45A through FIG. 45E.

In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 13 or a functional fragment thereof, or a nucleic acid sequence that, but for the redundancy of the genetic code, encodes the same polypeptide as one or more nucleic acid sequence of Table 13 or a functional fragment thereof.

In one embodiment, the Tryptophan Decarboxylase gene has at least about 80% identity with the entire sequence of

TABLE 13

Non-limiting examples of Sequences for Tryptophan to tryptamine conversion

| Description | Sequence |
|---|---|
| Tryptophan Decarboxylase (EC 4.1.1.28) Chain A, Ruminococcus *Gnavus* Tryptophan Decarboxylase Rumgna_01526 (alpha-fmt) SEQ ID NO: 95 | MSQVIKKKRNTFMIGTEYILNSTQLEEAIKSFVHDFCAEKHEIH DQPVVVEAKEHQEDKIKQIKIPEKGRPVNEVVSEMMNEVYRY RGDANHPRFFSFVPGPASSVSWLGDIMTSAYNIHAGGSKLAP MVNCIEQEVLKWLAKQVGFTENPGGVFVSGGSMANITALTA ARDNKLTDINLHLGTAYISDQTHSSVAKGLRIIGITDSRIRRIPT NSHFQMDTTKLEEAIETDKKSGYIPFVVIGTAGTTNTGSIDPLT EISALCKKHDMWFHIDGAYGASVLLSPKYKSLLTGTGLADSIS WDAHKWLFQTYGCAMVLVKDIRNLFHSFHVNPEYLKDLEN DIDNVNTWDIGMELTRPARGLKLWLTLQVLGSDLIGSAIEHG FQLAVWAEEALNPKKDWEIVSPAQMAMINFRYAPKDLTKEE QDILNEKISHRILESGYAAIFTTVLNGKTVLRICAIHPEATQED MQHTIDLLDQYGREIYTEMKKa |
| Tryptophan Decarboxylase (EC 4.1.1.28) Chain A, Ruminococcus *Gnavus* Tryptophan Decarboxylase Rumgna_01526 (alpha-fmt); codon optimized for the expression in *E. coli* SEQ ID NO: 96 | ATGAGTCAAGTGATTAAGAAGAAACGTAACACCTTTATGA TCGGAACGGAGTACATTCTTAACAGTACACAATTGGAGGA AGCGATTAAATCATTCGTACATGATTTCTGCGCAGAGAAGC ATGAGATCCATGACTCAACCTGTGGTAGTAGAAGCTAAAGA ACATCAGGAGGACAAAATCAAACAAATCAAAATCCCGGAA AAGGGACGTCCTGTAAATGAAGTCGTTTCTGAGATGATGA ATGAAGTGTATCGCTACCGCGGAGACGCCAACCATCCTCG CTTTTTTTCTTTTGTGCCCGGACCTGCAAGCAGTGTGTCGTG GTTGGGGGATATTATGACGTCCGCCTACAATATTCATGCTG GAGGCTCAAAGCTGGCACCGATGGTTAACTGCATTGAGCA GGAAGITCTGAAGTGGTTAGCAAAGCAAGTGGGGTTCACA GAAAATCCAGGTGGCGTATTTGTGTCGGGCGGTTCAATGG CGAATATTACGGCACTTACTGCGGCTCGTGACAATAAACTG ACCGACATTAACCTTCATTTGGGAACTGCTTATATTAGTGA CCAGACTCATAGTTCAGTTGCGAAAGGATTACGCATTATTG GAATCACTGACAGTCGCATCCGTCGCATTCCCACTAACTCC CACTTCCAGATGGATACCACCAAGCTGGAGGAAGCCATCG AGACCGACAAGAAGTCTGGCTACATTCGTTCGTCGTTATC GGAACAGCAGGTACCACCAACACTGGTTCGATTGACCCCC TGACAGAAATCTCTGCGTTATGTAAGAAGCATGACATGTG GTTTCATATCGACGGAGCGTATGGAGCTAGTGTTCTGCTGT CACCTAAGTACAAGAGCCTTCTTACCGGAACCGGCTTGGCT GACAGTATTTCGTGGGATGCTCATAAATGGTTGTTCCAAAC GTACGGCTGTGCAATGGTACTTGTCAAAGATATCCGTAATT TATTCCACTCTTTTCATGTGAATCCCGAGTATCTTAAGGAT CTGGAAAACGACATCGATAACGTTAATACATGGGACATCG GCATGGAGCTGACGCGCCCTGCACGCGGTCTTAAATTGTG GCTTACTTIACAGGTCCTTGGATCTGACTTGATTGGGAGTG CCATTGAACACGGTTTCCAGCTGGCAGTTTTGGGCTGAGGA AGCATTGAATCCAAAGAAAGACTGGGAGATCGTTTCTCCA GCTCAGATGGCTATGATTAATTTCCGTTATGCCCCTAAGGA TTTAACCAAAGAGGAACAGGATATTCTGAATGAAAAGATC TCCCACCGCATTTTAGAGAGCGGATACGCTGCAATTTTCAC TACTGTATTAAACGGCAAGACCGTTTTACGCATCTGTGCAA TTCACCCGGAGGCAACTCAAGAGGATATGCAACACACAAT CGACTTATTAGACCAATACGGTCGTGAAATCTATACCGAG ATGAAGAAAGCG |

In some embodiments, the genetically engineered bacteria comprise one or more nucleic acid sequence of Table 13 or a functional fragment thereof. In some embodiments, the genetically engineered bacteria comprise a nucleic acid sequence that, but for the redundancy of the genetic code, encodes the same polypeptide as one or more nucleic acid sequence of Table 13 or a functional fragment thereof. In SEQ ID NO: 95 or SEQ ID NO: 96: In another embodiment, the Tryptophan Decarboxylase gene has at least about 85% identity with the entire sequence of SEQ ID NO: 95 or SEQ ID NO: 96. In one embodiment, the Tryptophan Decarboxylase gene has at least about 90% identity with the entire sequence of SEQ ID NO: 95 or SEQ ID NO: 96. In one embodiment, the Tryptophan Decarboxylase gene has at least about 95% identity with the entire sequence of SEQ ID NO: 95 or SEQ ID NO: 96. In another embodiment, the Tryptophan Decarboxylase gene has at least about 96%, 97%, 98%, or 99% identity with the entire sequence of SEQ ID NO: 95 or SEQ ID NO: 96. Accordingly, in one embodiment, the Tryptophan Decarboxylase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 95 or SEQ ID NO: 96. In another embodiment, the Tryptophan Decarboxylase gene comprises the sequence of SEQ ID NO: 95 or SEQ ID NO: 96. In yet another embodiment the Tryptophan Decarboxylase gene consists of the sequence of SEQ ID NO: 95 or SEQ ID NO: 96.

In some embodiments, the genetically engineered bacteria comprise one or more gene cassettes which convert tryptophan to Indole-3-aldehyde and Indole Acetic Acid, e.g., via a tryptophan aminotransferase cassette. A non-limiting example of such a tryptophan aminotransferase expressed by the genetically engineered bacteria is in Table 14. In some embodiments, the genetically engineered bacteria take up tryptophan through an endogenous or exogenous transporter, and further produce Indole-3-aldehyde and Indole Acetic Acid from tryptophan. In some embodiments, the genetically engineered bacteria optionally comprise a tryptophan and/or indole metabolite exporter.

TABLE 14

| Exemplary tryptophan aminotransferase sequences | |
|---|---|
| Description | Sequence |
| Trp aminotransferase (EC 2.6.1.27); tryptophan aminotransferase [*Cryptococcus deuterogattii* R265] SEQ ID NO: 97 | MTATTISIETVPQAPAAGTKTNGTSGKYNPRTYLSDRAKVTEI DGSDAGRPNPDTFPFNSITLNLKPPLGLPESSNNMPVSITIEDPD LATALQYAPSAGIPKLREWLADLQAHVHERPRGDYAISVGSG SQDLMFKGFQAVLNPGDPVLLETPMYSGVLPALRILKADYAE VDVDDQGLSAKNLEKVLSEWPADKKRPRVLYTSPIGSNPSGC SASKERKLEVLKVCKKYDVLIFEDDPYYYLAQELIPSYFALEK QVYPEGGHVVRFDSFSKLLSAGMRLGFATGPKEILHAIDVSTA GANLHTSAVSQGVALRLMQYWGIEGFLAHGRAVAKLYTERR AQFEATAHKYLDGLATWVSPVAGMFLWIDLRPAGIEDSYELI RHEALAKGVLGVPGMAFYPTGRKSSHVRVSFSIVDLEDESDL GFQRLAEAIKDKRKALGLA |
| Trp aminotransferase (EC 2.6.1.27); tryptophan aminotransferase [*Cryptococcus deuterogattii* R265], codon optimized for expression in *E. coli* SEQ ID NO: 98 | ATGACGGCAACTACAATTTCTATTGAGACCGTACCTCAGGC CCCGGCGGCGGGGACCAAAACTAATGGGACTTCAGGAAAA TACAACCCCCGCACTTACCTGTCCGACCGCGCCAAAGTCAC TGAGATTGATGGATCTGACGCCGGTCGCCCCAATCCCGATA CTTTCCCATTTAACTCGATTACCTTAAATTTGAAACCACCTT TAGGCTTGCCCGAGAGTTCAAATAACATGCCGGTCTCTATC ACGATTGAAGACCCCGATTTAGCGACGGCCTTACAATATG CACCTAGCGCCGGTATTCCTAAGCTGCGCGAATGGCTGGCT GACTTACAAGCTCACGTTCATGAGCGCCCCCGTGGCGATTA TGCCATCTCGGTCGGGTCGGGGTCACAGGATTTGATGTTTA AGGGCTTCCAAGCTGTCTTGAATCCAGGTGATCCAGTCCTT CTGGAAACCCCAATGTATTCAGGTGTTCTGCCAGCGCTGCG CATTCTGAAGGCGGATTATGCAGAAGTTGATGTAGACGAC CAGGGGTTATCTGCTAAAAACCTTGAAAAAGTTTTATCAGA GTGGCCCGCAGATAAGAAGCGTCCTCGTGTCCTGTATACGT CGCCAATCGGCTCCAATCCTTCCGGATGTTCAGCATCCAAG GAACGCAAGTTAGAGGTACTGAAAGTCTGTAAGAAGTACG ATGTGCTGATCTTCGAAGACGATCCGTATTATTACCTTGCT CAAGAGCTTATTCCATCCTATTTTGCGTTGGAAAAACAAGT TTATCCGGAGGGTGGGCACGTTGTACGCTTTGACTCATTTA GTAAATTGCTTTCTGCTGGGATGCGCTTGGGATTTGCTACA GGGCCGAAGGAAATTCTTCATGCGATTGACGTCAGTACAG CAGGCGCAAATTTACATACTTCAGCGGTCTCTCAAGGTGTC GCTCTTCGCCTGATGCAGTATTGGGGGATCGAGGGATTCCT TGCACATGGCCGCGCGGTGGCCAAACTTTACACGGAGCGC CGCGCTCAGTTCGAGGCAACCGCACATAAGTACCTGGACG GGCTGGCCACTTGGGTATCTCCCGTAGCGGGAATGTTTTTA TGGATCGATCTTCGTCCAGCAGGAATCGAAGATTCTTACGA ATTAATTCGCCATGAAGCATTAGCCAAAGGCGTTTTAGGCG TTCCAGGGATGGCGTTTTATCCGACAGGCCGTAAGTCTTCC CATGTTCGTGTCAGTTTCAGTATCGTCGACCTGGAAGACGA ATCTGACCTTGGTTTTCAACGCCTGGCTGAAGCTATTAAGG ATAAACGCAAGGCTTTAGGGCTGGCT |

In some embodiments, the genetically engineered bacteria comprise one or more nucleic acid sequence of Table 14 or a functional fragment thereof. In some embodiments, the genetically engineered bacteria comprise a nucleic acid sequence that, but for the redundancy of the genetic code, encodes the same polypeptide as one or more nucleic acid sequence of Table 14 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 14 or a functional fragment thereof, or a nucleic acid sequence that, but for the redundancy of the genetic code, encodes the same polypeptide as one or more nucleic acid sequence of Table 14 or a functional fragment thereof.

In one embodiment, the Trp aminotransferase gene has at least about 80% identity with the entire sequence of SEQ ID NO: 97 or SEQ ID NO: 98. In another embodiment, the Trp aminotransferase gene has at least about 85% identity with the entire sequence of SEQ ID NO: 97 or SEQ ID NO: 98. In one embodiment, the Trp aminotransferase gene has at least about 90% identity with the entire sequence of SEQ ID NO: 97 or SEQ ID NO: 98. In one embodiment, the Trp aminotransferase gene has at least about 95% identity with the entire sequence of SEQ ID NO: 97 or SEQ ID NO: 98. In another embodiment, the Trp aminotransferase gene has at least about 96%, 97%, 98%, or 99% identity with the entire sequence of SEQ ID NO: 97 or SEQ ID NO: 98. Accordingly, in one embodiment, the Trp aminotransferase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 97 or SEQ ID NO: 98. In another embodiment, the Trp aminotransferase gene comprises the sequence of SEQ ID NO: 97 or SEQ ID NO: 98. In yet another embodiment the Trp aminotransferase gene consists of the sequence of SEQ ID NO: 97 or SEQ ID NO: 98.

The genetically engineered bacteria may comprise any suitable gene for producing Indole-3-aldehyde and/or Indole Acetic Acid and/or Tryptamine. In some embodiments, the gene for producing kynurenine is modified and/or mutated, e.g., to enhance stability, increase Indole-3-aldehyde and/or Indole Acetic Acid and/or Tryptamine production, and/or increase anti-inflammatory potency under inducing conditions. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the engineered bacteria also have enhanced export of a indole tryptophan metabolite, e.g., comprise an exporter or other mechanism for increasing the uptake of tryptophan into the bacterial cell, as discussed in detail above. In some embodiments, the genetically engineered bacteria are capable of producing Indole-3-aldehyde and/or Indole Acetic Acid and/or Tryptamine under inducing conditions, e.g., under a condition(s) associated with inflammation. In some embodiments, the genetically engineered bacteria are capable of producing kynurenine in low-oxygen conditions, in the presence of certain molecules or metabolites, in the presence of molecules or metabolites associated with inflammation or an inflammatory response, or in the presence of some other metabolite that may or may not be present in the gut, such as arabinose.

Table 15 comprises polypeptide sequences of such enzymes which are encoded by the genetically engineered bacteria of the disclosure.

TABLE 15

Tryptophan Pathway Catabolic Enzymes

| Description | Sequence |
|---|---|
| TDC: Tryptophan decarboxylase from *Catharanthus roseus* SEQ ID NO: 99 | MGSIDSTNVAMSNSPVGEFKPLEAEEFRKQAHRMVDFIADYY KNVETYPVLSEVEPGYLRKRIPETAPYLPEPLDDIMKDIQKDII PGMTNWMSPNFYAFFPATVSSAAFLGEMLSTALNSVGFTWV SSPAATELEMIVMDWLAQILKLPKSFMFSGTGGGVIQNTTSES ILCTIIAARERALEKLGPDSIGKLVCYGSDQTHTMFPKTCKLA GIYPNNIRLIPTTVETDFGISPQVLRKMVEDDVAAGYVPLFLC ATLGTTSTTATDPVDSLSEIANEFGIWIHVDAAYAGSACICPEF RHYLDGIERVDSLSLSPHKWLLAYLDCTCLWVKQPHLLLRAL TTNPEYLKNKQSDLDKVVDFKNWQIATGRKFRSLKLWLILRS YGVVNLQSHIRSDVAMGKMFEEWVRSDSRFEIVVPRNFSLVC FRLKPDVSSLHVEEVNKKLLDMLNSTGRVYMTHTIVGGIYML RLAVGSSLTEEHHVRRVWDLIQKLTDDLLKEA |
| TYNA: Monoamine oxidase from *E. coli* SEQ ID NO: 100 | MGSPSLYSARKTTLALAVALSFAWQAPVFAHGGEAHMVPM DKTLKEFGADVQWDDYAQLFTLIKDGAYVKVKPGAQTAIVN GQPLALQVPVVMKDNKAWVSDTFINDVFQSGLDQTFQVEKR PHPLNALTADEIKQAVEIVKASADFKPNTRFTEISLLPPDKEAV WAFALENKPVDQPRKADVIMLDGKHIIEAVVDLQNNKLLSW QPIKDAHGMVLLDDFASVQNIINNSEEFAAAVKKRGITDAKK VITTPLTVGYFDGKDGLKQDARLLKVISYLDVGDGNYWAHPI ENLVAVVDLEQKKIVKIEEGPVVPVPMTARPFDGRDRVAPAV KPMQIIEPEGKNYTITGDMIHWRNWDFHLSMNSRVGPMISTV TYNDNGTKRKVMYEGSLGGMIVPYGDPDIGWYFKAYLDSGD YGMGTLTSPIARGKDAPSNAVLLNETIADYTGVPMEIPRAIAV FERYAGPEYKHQEMGQPNVSTERRELVVRWISTVGNYDYIFD WIFHENGTIGIDAGATGIEAVKGVKAKTMHDETAKDDTRYGT LIDHNIVGTTHQHIYNFRLDLDVDGENNSLVAMDPVVKPNTA GGPRTSTMQVNQYNIGNEQDAAQKFDPGTIRLLSNPNKENRM GNPVSYQIIPYAGGTHPVAKGAQFAPDEWIYHRLSFMDKQLW VTRYHPGERFPEGKYPNRSTHDTGLGQYSKDNESLDNTDAV VWMTTGTTHVARAEEWPIMPTEWVHTLLKPWNFFDETPTLG ALKKDK |

TABLE 15-continued

Tryptophan Pathway Catabolic Enzymes

| Description | Sequence |
|---|---|
| AAO1: Indole-3-acetaldehyde oxidase from *Arabidopsis thaliana* SEQ ID NO: 101 | MGEKAIDEDKVEAMKSSKTSLVFAINGQRFELELSSIDPSTTL VDFLRNKTPFKSVKLGCGEGGCGACVVLLSKYDPLLEKVDEF TISSCLTLLCSIDGCSITTSDGLGNSRVGFHAVHERIAGFHATQ CGFCTPGMSVSMFSALLNADKSHPPPRSGFSNLTAVEAEKAV SGNLCRCTGYRPLVDACKSFAADVDIEDLGFNAFCKKGENRD EVLRRLPCYDHTSSHVCTFPEFLKKEIKNDMSLHSRKYRWSSP VSVSELQGLLEVENGLSVKLVAGNTSTGYYKEEKERKYERFI DIRKIPEFTMVRSDEKGVELGACVTISKAIEVLREEKNVSVLA KIATHMEKIANRFVRNTGTIGGNIMMAQRKQFPSDLATILVA AQATVKIMTSSSSQEQFTLEEFLQQPPLDAKSLLLSLEIPSWHS AKKNGSSEDSILLFETYRAAPRPLGNALAFLNAAFSAEVTEAL DGIVVNDCQLVFGAYGTKHAHRAKKVEEFLTGKVISDEVLM EAISLLKDEIVPDKGTSNPGYRSSLAVTFLFEFFGSLTKKNAKT TNGWLNGGCKEIGFDQNVESLKPEAMLSSAQQIVENQEHSPV GKGITKAGACLQASGEAVYVDDIPAPENCLYGAFIYSTMPLA RIKGIRFKQNRVPEGVLGIITYKDIPKGGQNIGTNGFFTSDLLF AEEVTHCAGQIIAFLVADSQKHADIAANLVVIDYDTKDLKPPI LSLEEAVENFSLFEVPPPLRGYPVGDITKGMDEAEHKILGSKIS FGSQYFFYMETQTALAVPDEDNCMVVYSSTQTPEFVHQTIAG CLGVPENNVRVITRRVGGGFGGKAVKSMPVAAACALAASK MQRPVRTYVNRKTDMITTGGRHPMKVTYSVGFKSNGKITAL DVEVLLDAGLTEDISPLMPKGIQGALMKYDWGALSFNVKVC KTNTVSRTALRAPGDVQGSYIGEAIIEKVASYLSVDVDEIRKV NLHTYESLRLFHSAKAGEFSEYTLPLLWDRIDEFSGFNKRRKV VEEFNASNKWRKRGISRVPAVYAVNMRSTPGRVSVLGDGSIV VEVQGIEIGQGLWTKVKQMAAYSLGLIQCGTTSDELLKKIRVI QSDTLSMVQGSMTAGSTTSEASSEAVRICCDGLVERLLPVKT ALVEQTGGPVTWDSLISQAYQQSINMSVSSKYMPDSTGEYLN YGIAASEVEVNVLTGETTILRTDIIYDCGKSLNPAVDLGQIEGA FVQGLGFFMLEEFLMNSDGLVVTDSTWTYKIPTVDTIPRQFN VEILNSGQHKNRVLSSKASGEPPLLLAASVHCAVRAAVKEAR KQILSWNSNKQGTDMYFELPVPATMPIVKEFCGLDVVEKYLE WKIQQRKNV |
| ARO9: L-tryptophan aminotransferase from *S. cerevisae* SEQ ID NO: 102 | MTAGSAPPVDYTSLKKNFQPFLSRRVENRSLKSFWDASDISD DVIELAGGMPNERFFPIESMDLKISKVPFNDNPKWHNSFTTAH LDLGSPSELPIARSFQYAETKGLPPLLHFVKDFVSRINRPAFSD ETESNWDVILSGGSNDSMFKVFETICDESTTVMIEEFTFTPAM SNVEATGAKVIPIKMNLTFDRESQGIDVEYLTQLLDNWSTGP YKDLNKPRVLYTIATGQNPTGMSVPQWKREKIYQLAQRHDF LIVEDDPYGYLYFPSYNPQEPLENPYHSSDLTTERYLNDFLMK SFLTLDTDARVIRLETFSKIFAPGLRLSFIVANKFLLQKILDLAD ITTRAPSGTSQAIVYSTIKAMAESNLSSSLSMKEAMFEGWIRW IMQIASKYNHRKNLTLKALYETESYQAGQFTVMEPSAGMFIII KINWGNFDRPDDLPQQMDILDKFLLKNGVKVVLGYKMAVCP NYSKQNSDFLRLTIAYARDDDQLIEASKRIGSGIKEFFDNYKS |
| aspC: aspartate aminotransferase from *E. coli* SEQ ID NO: 103 | MFENITAAPADPILGLADLFRADERPGKINLGIGVYKDETGKT PVLTSVKKAEQYLLENETTKNYLGIDGIPEFGRCTQELLFGKG SALINDKRARTAQTPGGTGALRVAADFLAKNTSVKRVWVSN PSWPNHKSVFNSAGLEVREYAYYDAENHTLDFDALINSLNEA QAGDVVLFHGCCHNPTGIDPTLEQWQTLAQLSVEKGWLPLF DFAYQGFARGLEEDAEGLRAFAAMHKELIVASSYSKNFGLYN ERVGACTLVAADSETVDRAFSQMKAAIRANYSNPPAHGASV VATILSNDALRAIWEQELTDMRQRIQRMRQLFVNTLQEKGAN RDFSFIIKQNGMFSFSGLTKEQVLRLREEFGVYAVASGRVNVA GMTPDNMAPLCEAIVAVL |
| TAA1: L-tryptophan-pyruvate aminotransferase from *Arabidopsis thaliana* SEQ ID NO: 104 | MVKLENSRKPEKISNKNIPMSDFVVNLDHGDPTAYEEYWRK MGDRCTVTIRGCDLMSYFSDMTNLCWFLEPELEDAIKDLHGV VGNAATEDRYIVVGTGSTQLCQAAVHALSSLARSQPVSVVA AAPFYSTYVEETTYVRSGMYKWEGDAWGFDKKGPYIELVTS PNNPDGTIRETVVNRPDDDEAKVIHDFAYYWPHYTPITRRQD HDIMLFTFSKITGHAGSRIGWALVKDKEVAKKMVEYIIVNSIG VSKESQVRTAKILNVLKETCKSESESENPFFKYGREMMKNRWE KLREVVKESDAFTLPKYPEAFCNYFGKSLESYPAFAWLGTKE ETDLVSELRRHKVMSRAGERCGSDKKHVRVSMLSREDVFNV FLERLANMKLIKSIDL |
| STAO: L-tryptophan oxidase from *streptomyces* sp. TP-A0274 SEQ ID NO: 105 | MTAPLQDSDGPDDAIGGPKQVTVIGAGIAGLVTAYELERLGH HVQIIEGSDDIGGRIHTHRFSGAGGPGPFAEMGAMRIPAGHRL TMHYIAELGLQNQVREFRTLFSDDAAYLPSSAGYLRVREAHD TLVDEFATGLPSAHYRQDTLLFGAWLDASIRAIAPRQFYDGL HNDIGVELLNLVDDIDLTPYRCGTARNRIDLHALFADHPRVR ASCPPRLERFLDDVLDETSSSIVRLKDGMDELPRRLASRIRGKI SLGQEVTGIDVHDDTVTLTVRQGLRTVTRTCDYVVCTIPFTVL |

TABLE 15-continued

Tryptophan Pathway Catabolic Enzymes

| Description | Sequence |
|---|---|
| | RTLRLTGFDQDKLDIVHETKYWPATKIAFHCREPFWEKDGIS<br>GGASFTGGHVRQTYYPPAEGDPALGAVLLASYTIGPDAEALA<br>RMDEAERDALVAKELSVMHPELRRPGMVLAVAGRDWGARR<br>WSRGAATVRWGQEAALREAERRECARPQKGLFFAGEHCSSK<br>PAWIEGAIESAIDAAHEIEWYEPRASRVFAASRLSRSDRSA |
| ipdC: Indole-3-pyruvate decarboxylase from *Enterobacter cloacae* SEQ ID NO: 106 | MRTPYCVADYLLDRLTDCGADHLFGVPGDYNLQFLDHVIDS<br>PDICWVGCANELNASYAADGYARCKGFAALLTTFGVGELSA<br>MNGIAGSYAEHVPVLHIVGAPGTAAQQRGELLHHTLGDGEFR<br>HFYHMSEPITVAQAVLTEQNACYEIDRVLTTMLRERRPGYLM<br>LPADVAKKAATPPVNALTHKQAHADSACLKAFRDAAENKLA<br>MSKRTALLADFLVLRHGLKHALQKWVKEVPMAHATMLMG<br>KGIFDERQAGFYGTYSGSASTGAVKEAIEGADTVLCVGTRFT<br>DTLTAGFTHQLTPAQTIEVQPHAARVGDVWFTGIPMNQAIET<br>LVELCKQHVAGLMSSSSGAIPFPQPDGSLTQENFWRTLQTFI<br>RPGDIILADQGTSAFGAIDLRLPADVNFIVQPLWGSIGYTLAA<br>AFGAQTACPNRRVIVLTGDGAAQLTIQELGSMLRDKQHPIILV<br>LNNEGYTVERAIHGAEQRYNDIALWNWTHIPQALSLDPQSEC<br>WRVSEAEQLADVLEKVAHHERLSLIEVMLPKADIPPLLGALT<br>KALEACNNA |
| IAD1: Indole-3-acetaldehyde dehydrogenase from *Ustilago maydis* SEQ ID NO: 107 | MPTLNLDLPNGIKSTIQADLFINNKFVPALDGKTFATINPSTGK<br>EIGQVAEASAKDVDLAVKAAREAFETTWGENTPGDARGRLLI<br>KLAELVEANIDELAAIESLDNGKAFSIAKSFDVAAVAANLRY<br>YGGWADKNHGKVMEVDTKRLNYTRHEPIGVCGQIIPWNFPL<br>LMFAWKLGPALATGNTIVLKTAEQTPLSAIKMCELIVEAGFPP<br>GVVNVISGFGPVAGAAISQHMDIDKIAFTGSTLVGRNIMKAA<br>ASTNLKKVTLELGGKSPNIIFKDADLDQAVRWSAFGIMFNHG<br>QCCCAGSRVYVEESIYDAFMEKMTAHCKALQVGDPFSANTF<br>QGPQVSQLQYDRIMEYIESGKKDANLALGGVRKGNEGYFIEP<br>TIFTDVPHDAKIAKEEIFGPVVVVSKFKDEKDLIRIANDSIYGL<br>AAAVFSRDISRAIETAHKLKAGTVWVNCYNQLIPQVPFGGYK<br>ASGIGRELGEYALSNYTNIKAVHVNLSQPAPI |
| YUC2: indole-3-pyruvate monooxygenase from *Arabidopsis thaliana* SEQ ID NO: 108 | MEFVTETLGKRIHDPYVEETRCLMIPGPIIVGSGPSGLATAACL<br>KSRDIPSLILERSTCIASLWQHKTYDRLRLHLPKDFCELPLMPF<br>PSSYPTYPTKQQFVQYLESYAEHFDLKPVFNQTVEEAKFDRR<br>CGLWRVRTTGGKKDETMEYVSRWLVVATGENAEEVMPEID<br>GIPDFGGPILHTSSYKSGEIFSEKKILVVGCGNSGMEVCLDLCN<br>FNALPSLVVRDSVHVLPQEMLGISTFGISTSLLKWFPVHVVDR<br>FLLRMSRLVLGDTDRLGLVRPKLGPLERKIKCGKTPVLDVGT<br>LAKIRSGHIKVYPELKRVMHYSAEFVDGRVDNFDAIILATGY<br>KSNVPMWLKGVNMFSEKDGFPHKPFPNGWKGESGLYAVGF<br>TKLGLLGAAIDAKKIAEDIEVQRHFLPLARPQHC |
| IaaM: Tryptophan 2-monooxygenase from *Pseudomonas savastanoi* SEQ ID NO: 109 | MYDHFNSPSIDILYDYGPPFLKKCEMTGGIGSYSAGTPTPRVAI<br>VGAGISGLVAATELLRAGVKDVVLYESRDRIGGRVWSQVFD<br>QTRPRYIAEMGAMRFPPSATGLFHYLKKFGISTSTTFPDPGVV<br>DTELHYRGKRYHWPAGKKPPELFRRVYEGWQSLLSEGYLLE<br>GGSLVAPLDITAMLKSGRLEEAAIAWQGWLNVFRDCSFYNAI<br>VCIFTGRHPPGGDRWARPEDFELFGSLGIGSGGFLPVFQAGFT<br>EILRMVINGYQSDQRLIPDGISSLAARLADQSFDGKALRDRVC<br>FSRVGRISREAEKIIQTEAGEQRVFDRVIVTSSNRAMQMIHCL<br>TDSESFLSRDVARAVRETHLTGSSKLFILTRTKFWIKNKLPTTI<br>QSDGLVRGVYCLDYQPDEPEGHGVVLLSYTWEDDAQKMLA<br>MPDKKTRCQVLVDDLAAIHPTFASYLLPVDGDYERYVLHHD<br>WLTDPHSAGAFKLNYPGEDVYSQRLFFQPMTANSPNKDTGL<br>YLAGCSCSFAGGWIEGAVQTALNSACAVLRSTGGQLSKGNPL<br>DCINASYRY |
| iaaH: Indoleacetamide hydrolase from *Pseudomonas savastanoi* SEQ ID NO: 110 | MHEIITLESLCQALADGEIAAAELRERALDTEARLARLNCFIRE<br>GDAVSQFGEADHAMKGTPLWGMPVSFKDNICVRGLPLTAGT<br>RGMSGFVSDQDAAIVSQLRALGAVVAGKNNMHELSFGVTSI<br>NPHWGTVGNPVAPGYCAGGSSGGSAAAVASGIVPLSVGTDT<br>GGSIRIPAAFCGITGFRPTTGRWSTAGIIPVSHTKDCVGLLTRT<br>AGDAGFLYGLLSGKQQSFPLSRTAPCRIGLPVSMWSDLDGEV<br>ERACVNALSLLRKTGFEFIEIDDADIVELNQTLTFTVPLYEFFA<br>DLAQSLLSLGWKHGIHHIFAQVDDANVKGIINHHLGEGAIKP<br>AHYLSSLQNGELLKRKMDELFARHNIELLGYPTVPCRVPHLD<br>HADRPEFFSQAIRNTDLASNAMLPSITIPVGPEGRLPVGLSFDA<br>LRGRDALLLSRVSAIEQVLGFVRKVLPHTT |

TABLE 15-continued

Tryptophan Pathway Catabolic Enzymes

| Description | Sequence |
|---|---|
| TrpDH: Tryptophan dehydrogenase from *Nostoc punctiforme* NIES-2108 SEQ ID NO: 111 | MLLFETVREMGHEQVLFCHSKNPEIKAIIAIHDTTLGPAMGAT RILPYINEEAALKDALRLSRGMTYKAACANIPAGGGKAVIIAN PENKTDDLLRAYGRFVDSLNGRFITGQDVNITPDDVRTISQET KYVVGVSEKSGGPAPITSLGVFLGIKAAVESRWQSKRLDGMK VAVQGLGNVGKNLCRHLHEHDVQLFVSDVDPIKAEEVKRLF GATVVEPTEIYSLDVDIFAPCALGGILNSHTIPFLQASIIAGAAN NQLENEQLHSQMLAKKGILYSPDYVINAGGLINVYNEMIGYD EEKAFKQVHNIYDTLLAIFEIAKEQGVTTNDAARRLAEDRINN SKRSKSKAIAA |
| CYP79B2: tryptophan N-monooxygenase from *Arabidopsis thaliana* SEQ ID NO: 112 | MNTFTSNSSDLTTTATETSSFSTLYLLSTLQAFVAITLVMLLKK LMTDPNKKKPYLPPGPTGWPIIGMIPTMLKSRPVFRWLHSIMK QLNTEIACVKLGNTHVITVTCPKIAREILKQQDALFASRPLTY AQKILSNGYKTCVITPFGDQFKKMRKVVMTELVCPARHRWL HQKRSEENDHLTAWVYNMVKNSGSVDFRFMTRHYCGNAIK KLMFGTRTFSKNTAPDGGPTVEDVEHMEAMFEALGFTFAFCI SDYLPMLTGLDLNGHEKIMRESSAIMDKYHDPIIDERIKMWR EGKRTQIEDFLDIFISIKDEQGNPLLTADEIKPTIKELVMAAPDN PSNAVEWAMAEMVNKPEILRKAMEEIDRVVGKERLVQESDIP KLNYVKAILREAFRLHPVAAFNLPHVALSDTTVAGYHIPKGS QVLLSRYGLGRNPKVWADPLCFKPERHLNECSEVTLTENDLR FISFSTGKRGCAAPALGTALTTMMLARLLQGFTWKLPENETR VELMESSHDMFLAKPLVMVGDLRLPEHLYPTVK |
| CYP79B3: tryptophan N-monooxygenase from *Arabidopsis thaliana* SEQ ID NO: 113 | MDTLASNSSDLTTKSSLGMSSFTNMYLLTTLQALAALCFLMI LNKIKSSSRNKKLHPLPPGPTGFPIVGMIPAMLKNRPVFRWLH SLMKELNTEIACVRLGNTHVIPVTCPKIAREIFKQQDALFASRP LTYAQKILSNGYKTCVITPFGEQPKKMRKVIMTEIVCPARHR WLHDNRAEETDHLTAWLYNMVKNSEPVDLRFVTRHYCGNA IKRLMFGTRTFSEKTEADGGPTLEDIEHMDAMFEGLGFTFAFC ISDYLPMLTGLDLNGHEKIMRESSAIMDKYHDPIIDERIKMWR EGKRTQIEDFLDIFISIKDEAGQPLLTADEIKPTIKELVMAAPDN PSNAVEWAIAEMINKPEILHKAMEEIDRVVGKERFVQESDIPK LNYVKAIIREAFRLHPVAAFNLPHVALSDTTVAGYHIPKGSQV LLSRYGLGRNPKVWSDPLSFKPERHLNECSEVTLTENDLRFIS FSTGKRGCAAPALGTAITTMMLARLLQGFKWKLAGSETRVE LMESSHDMFLSKPLVLVGELRLSEDLYPMVK |
| CYP71A13: indoleacetaldoxime dehydratase from *Arabidopis thaliana* SEQ ID NO: 114 | MSNIQEMEMILSISLCLTTLITLLLLRRFLKRTATKVNLPPSPW RLPVIGNLHQLSLHPHRSLRSLSLRYGPLMLLHFGRVPILVVSS GEAAQEVLKTHDHKFANRPRSKAVHGLMNGGRDVVFAPYG EYWRQMKSVCILNLLTNKMVESFEKVREDEVNAMIEKLEKA SSSSSSENLSELFITLPSDVTSRVALGRKHSEDETARDLKKRVR QIMELLGEFPIGEYVPILAWIDGIRGFNNKIKEVSRGFSDLMDK VVQEHLEASNDKADFVDILLSIEKDKNSGFQVQRNDIKFMILD MFIGGTSTTSTLLEWTMTELIRSPKSMKKLQDEIRSTIRPHGSY IKEKEVENMKYLKAVIKEVLRLHPSLPMILPRLLSEDVKVKGY NIAAGTEVIINAWAIQRDTAIWGPDAEEFKPERHLDSGLDYHG KNLNYIPFGSGRRICPGINLALGLAEVTVANLVGRFDWRVEA GPNGDQPDLTEAIGIDVCRKFPLIAFPSSVV |
| PEN2: myrosinase from *Arabidopsis thaliana* SEQ ID NO: 115 | MAHLQRTFPTEMSKGRASFPKGFLFGTASSSYQYEGAVNEGA RGQSVWDHFSNRFPHRISDSSDGNVAVDFYHRYKEDIKRMK DINMDSFRLSIAWPRVLPYGKRDRGVSEEGIKFYNDVIDELLA NEITPLVTIFHWDIPQDLEDEYGGFLSEQIIDDFRDYASLCFERF GDRVSLWCTMNEPWVYSVAGYDTGRKAPGRCSKYVNGASV AGMSGYEAYIVSHNMLLAHAEAVEVFRKCDHIKNGQIGIAHN PLWYEPYDPSDPDDVEGCNRAMDFMLGWHQHPTACGDYPE TMKKSVGDRLPSFTPEQSKKLIGSCDYVGINYYSSLFVKSIKH VDPTQPTWRTDQGVDWMKTNIDGKQIAKQGGSEWSFTYPTG LRNILKYVKKTYGNPPILITENGYGEVAEQSQSLYMYNPSIDT ERLEYIEGHIHAIHQAIHEDGVRVEGYYVWSLLDNFEWNSGY GVRYGLYYIDYKDGLRRYPKMSALWLKEFLRFDQEDDSSTS KKEEKKESYGKQLLHSVQDSQFVHSIKDSGALPAVLGSLFVV SATVGTSLFFKGANN |
| Nit1: Nitrilase from *Arabidopsis thaliana* SEQ ID NO: 116 | MSSTKDMSTVQNATPFNGVAPSTTVRVTIVQSSTVYNDTPATI DKAEKYIVEAASKGAELVLFPEGIGGYPRGFRFGLAVGVHN EEGRDEFRKYHASAIHVPGPEVARLADVARKNHVYLVMGAI EKEGYTLYCTVLFFSPQGQFLGKHRKLMPTSLERCIWGQGDG STIPVYDTPIGKLGAAICWENRMPLYRTALYAKGIELYCAPTA DGSKEWQSSMLHIAIEGGCFVLSACQFCQRKHFPDHPDYLFT DWYDDKEHDSIVSQGGSVIISPLGQVLAGPNFESEGLVTADID LGDIARAKLYFDSVGHYSRPDVLHLTVNEHPRKSVTFVTKVE KAEDDSNK |

TABLE 15-continued

Tryptophan Pathway Catabolic Enzymes

| Description | Sequence |
|---|---|
| IDO1: indoleamine 2,3-dioxygenase from *homo sapiens* SEQ ID NO: 117 | MAHAMENSWTISKEYHIDEEVGFALPNPQENLPDFYNDWMFI AKHLPDLIESGQLRERVEKLNMLSIDHLTDHKSQRLARLVLG CITMAYVWGKGHGDVRKVLPRNIAVPYCQLSKKLELPPILVY ADCVLANWKKKDPNKPLTYENMDVLFSFRDGDCSKGFFLVS LLVEIAAASAIKVIPTVFKAMQMQERDTLLKALLEIASCLEKA LQVFHQIHDHVNPKAFFSVLRIYLSGWKGNPQLSDGLVYEGF WEDPKEFAGGSAGQSSVFQCFDVLLGIQQTAGGGHAAQFLQ DMRRYMPPAHRNFLCSLESNPSVREFVLSKGDAGLREAYDA CVKALVSLRSYHLQIVTKYILIPASQQPKENKTSEDPSKLEAK GTGGTDLMNFLKTVRSTTEKSLLKEG |
| TDO2: tryptophan 2,3-dioxygenase from *homo sapiens* SEQ ID NO: 118 | MSGCPFLGNNFGYTFKKLPVEGSEEDKSQTGVNRASKGGLIY GNYLHLEKVLNAQELQSETKGNKIHDEHLFIITHQAYELWFK QILWELDSVREIFQNGHVRDERNMLKVVSRMHRVSVILKLLV QQFSILETMTALDFNDFREYLSPASGFQSLQFRLLENKIGVLQ NMRVPYNRRHYRDNFKGEENELLLKSEQEKTLLELVEAWLE RTPGLEPHGFNFWGKLEKNITRGLEEEFIRIQAKEESEEKEEQV AEFQKQKEVLLSLFDEKRHEHLLSKGERRLSYRALQGALMIY FYREEPRFQVPFQLLTSLMDIDSLMTKWRYNHVCMVHRMLG SKAGTGGSSGYHYLRSTVSDRYKVFVDLFNLSTYLIPRHWIPK MNPTIHKFLYTAEYCDSSYFSSDESD |
| BNA2: indoleamine 2,3-dioxygenase from *S. cerevisiae* SEQ ID NO: 119 | MNNTSITGPQVLHRTKMRPLPVLEKYCISPHHGFLDDRLPLTR LSSKKYMKWEEIVADLPSLLQEDNKVRSVIDGLDVLDLDETIL GDVRELRRAYSILGFMAHAYIWASGTPRDVLPECIARPLLETA HILGVPPLATYSSLVLWNFKVTDECKKTETGCLDLENITTINTF TGTVDESWFYLVSVRFEKIGSACLNHGLQILRAIRSGDKGDA NVIDGLEGLAATIERLSKALMEMELKCEPNVFYFKIRPPLAGW TNMSHMGLPQGVRYGAEGQYRIFSGGSNAQSSLIQTLDILLG VKHTANAAHSSQGDSKINYLDEMKKYMPREHREFLYHLESV CNIREYVSRNASNRALQEAYGRCISMLKIFRDNHIQIVTKYIIL PSNSKQHGSNKPNVLSPIEPNTKASGCLGHKVASSKTIGTGGT RLMPFLKQCRDETVATADIKNEDKN |
| Afmid: Kynurenine formamidase from mouse SEQ ID NO: 120 | MAFPSLSAGQNPWRNLSSEELEKQYSPSRWVIHTKPEEVVGN FVQIGSQATQKARATRRNQLDVPYGDGEGEKLDIYFPDEDSK AFPPLFLFLHGGYWQSGSKDDSAFMVNPLTAQGIVVVIVANI APKGTLDQMVDQVTRSVVFLQRRYPSNEGIYLCGHSAGAHL AAMVLLARWTKHGVTPNLQGFLLVSGIYDLEPLIATSQNDPL RMTLEDAQRNSPQRHLDVVPAQPVAPACPVLVLVGQHDSPE FHRQSKEFYETLLRVGWKASFQQLRGVDHFDIIENLTREDDV LTQIILKTVFQKL |
| BNA3: kynurenine-- oxoglutarate transaminase from *S. cerevisae* SEQ ID NO: 121 | MKQRFIRQFTNLMSTSRPKVVANKYFTSNTAKDVWSLTNEA AAKAANNSKNQGRELINLGQGFFSYSPPQFAIKEAQKALDIPM VNQYSPTRGRPSLINSLIKLYSPIYNTELKAENVTVTTGANEGI LSCLMGLLNAGDEVIVFEPFFDQYIPNIELCGGKVVYVPINPPK ELDQRNTRGEEWTIDFEQFEKAITSKTKAVIINTPHNPIGKVFT REELTTLGNICVKHNVVIISDEVYEHLYFTDSFTRIATLSPEIGQ LTLTVGSAGKSFAATGWRIGWVLSLNAELLSYAAKAHTRICF ASPSPLQEACANSINDALKIGYFEKMRQEYINKFKIFTSIFDEL GLPYTAPEGTYFVLVDFSKVKIPEDYPYPEEILNKGKDFRISH WLINELGVVAIPPTEFYIKEHEKAAENLLRFAVCKDDAYLEN AVERLKLLKDYL |
| GOT2: Aspartate aminotransferase, mitochondrial from *homo sapiens* SEQ ID NO: 122 | MALLHSGRVLPGIAAAFHPGLAAAASARASSWWTHVEMGPP DPILGVTEAFKRDTNSKKMNLGVGAYRDDNGKPYVLPSVRK AEAQIAAKNLDKEYLPIGGLAEFCKASAELALGENSEVLKSG RFVTVQTISGTGALRIGASFLQRFFKFSRDVFLPKPTWGNHTPI FRDAGMQLQGYRYYDPKTCGFDFTGAVEDISKIPEQSVLLLH ACAHNPTGVDPRPEQWKEIATVVKKRNLFAFFDMAYQGFAS GDGDKDAWAVRHFIEQGINVCLCQSYAKNMGLYGERVGAFT MVCKDADEAKRVESQLKILIRPMYSNPPLNGARIAAAILNTPD LRKQWLQEVKVMADRIIGMRTQLVSNLKKEGSTHNWQHITD QIGMFCFTGLKPEQVERLIKEFSIYMTKDGRISVAGVTSSNVG YLAHAIHQVTK |
| AADAT: Kynurenine/alpha- aminoadipate aminotransferase, mitochondrial SEQ ID NO: 123 | MNYARFITAASAARNPSPIRTMTDILSRGPKSMISLAGGLPNP NMFPFKTAVITVENGKTIQFGEEMMKRALQYSPSAGIPELLSW LKQLQIKLHNPPTIHYPPSQGQMDLCVTSGSQQGLCKVFEMII NPGDNVLLDEPAYSGTLQSLHPLGCNIINVASDESGIVPDSLR DILSRWKPEDAKNPQKNTPKFLYTVPNGNNPTGNSLTSERKK EIYELARKYDFLIIEDDPYYFLQFNKFRVPTFLSMDVDGRVIRA DSFSKIISSGLRIGFLTGPKPLIERVILHIQVSTLHPSTFNQLMIS QLLHEWGEEGFMAHVDRVIDFYSNQKDAILAAADKWLTGLA |

TABLE 15-continued

Tryptophan Pathway Catabolic Enzymes

| Description | Sequence |
|---|---|
| | EWHVPAAGMFLWIKVKGINDVKELIEEKAVKMGVLMLPGN<br>AFYVDSSAPSPYLRASFSSASPEQMDVAFQVLAQLIKESL |
| CCLB1: Kynurenine--<br>oxoglutarate<br>transaminase 1 from<br>*homo sapiens*<br>SEQ ID NO: 124 | MAKQLQARRLDGIDYNPWVEFVKLASEHDVVNLGQGFPDFP<br>PPDFAVEAFQHAVSGDFMLNQYTKTFGYPPLTKILASFFGELL<br>GQEIDPLRNVLVTVGGYGALFTAFQALVDEGDEVIIIEPFFDC<br>YEPMTMMAGGRPVFVSLKPGPIQNGELGSSSNWQLDPMELA<br>GKFTSRTKALVLNTPNNPLGKVFSREELELVASLCQQHDVVCI<br>TDEVYQWMVYDGHQHISIASLPGMWERTLTIGSAGKTFSATG<br>WKVGWVLGPDHIMKHLRTVHQNSVFHCPTQSQAAVAESFER<br>EQLLFRQPSSYFVQFPQAMQRCRDHMIRSLQSVGLKPIIPQGS<br>YFLITDISDFKRKMPDLPGAVDEPYDRRFVKWMIKNKGLVAI<br>PVSIFYSVPHQKHFDHYIRFCFVKDEATLQAMDEKLRKWKVEL |
| CCLB2: kynurenine--<br>oxoglutarate<br>transaminase 3 from<br>*homo sapiens*<br>SEQ ID NO: 125 | MFLAQRSLCSLSGRAKFLKTISSSKILGFSTSAKMSLKFTNAKR<br>IEGLDSNVWIEFTKLAADPSVVNLGQGFPDISPPTYVKEELSKI<br>AAIDSLNQYTRGFGHPSLVKALSYLYEKLYQKQIDSNKEILVT<br>VGAYGSLFNTIQALIDEGDEVILIVPFYDCYEPMVRMAGATPV<br>FIPLRSKPVYGKRWSSSDWTLDPQELESKFNSKTKAIILNTPHN<br>PLGKVYNREELQVIADLCIKYDTLCISDEVYEWLVYSGNKHL<br>KIATFPGMWERTITIGSAGKTFSVTGWKLGWSIGPNHLIKHLQ<br>TVQQNTIYTCATPLQEALAQAFWIDIKRMDDPECYFNSLPKEL<br>EVKRDRMVRLLESVGLKPIVPDGGYFIIADVSLLDPDLSDMK<br>NNEPYDYKFVKWMTKHKKLSAIPVSAFCNSETKSQFEKFVRF<br>CFIKKDSTLDAAEEIIKAWSVQKS |
| TnaA: tryptophanase<br>from *E. coli*<br>SEQ ID NO: 126 | MENFKHLPEPFRIRVIEPVKRTTRAYREEAIIKSGMNPFLLDSE<br>DVFIDLLTDSGTGAVTQSMQAAMMRGDEAYSGSRSYYALAE<br>SVKNIFGYQYTIPTHQGRGAEQIYIPVLIKKREQEKGLDRSKM<br>VAFSNYFFDTTQGHSQINGCTVRNVYIKEAFDTGVRYDFKGN<br>FDLEGLERGIEEVGPNNVPYIVATITSNSAGGQPVSLANLKAM<br>YSIAKKYDIPVVMDSARFAENAYFIKQREAEYKDWTIEQITRE<br>TYKYADMLAMSAKKDAMVPMGGLLCMKDDSFFDVYTECRT<br>LCVVQEGFPTYGGLEGGAMERLAVGLYDGMNLDWLAYRIA<br>QVQYLVDGLEEIGVVCQQAGGHAAFVDAGKLLPHIPADQFP<br>AQALACELYKVAGIRAVEIGSFLLGRDPKTGKQLPCPAELLRL<br>TIPRATYTQTHMDFIIEAFKHVKENAANIKGLTFTYEPKVLRH<br>FTAKLKEV |

In one embodiment, the tryptophan pathway catabolic enzyme has at least about 80% identity with the entire sequence of one or more of SEQ ID NO: 99 through SEQ ID NO: 126. In another embodiment, the tryptophan pathway catabolic enzyme has at least about 85% identity with the entire sequence of one or more SEQ ID NO: 99 through SEQ ID NO: 126. In one embodiment, the tryptophan pathway catabolic enzyme has at least about 90% identity with the entire sequence of one or more SEQ ID NO: 99 through SEQ ID NO: 126. In one embodiment, the tryptophan pathway catabolic enzyme has at least about 95% identity with the entire sequence of one or more SEQ ID NO: 99 through SEQ ID NO: 126. In another embodiment, the tryptophan pathway catabolic enzyme has at least about 96%, 97%, 98%, or 99% identity with the entire sequence of one or more SEQ ID NO: 99 through SEQ ID NO: 126. Accordingly, in one embodiment, the tryptophan pathway catabolic enzyme has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of one or more SEQ ID NO: 99 through SEQ ID NO: 126. In another embodiment, the tryptophan pathway catabolic enzyme comprises the sequence of one or more SEQ ID NO: 99 through SEQ ID NO: 126. In yet another embodiment the tryptophan pathway catabolic enzyme consists of the sequence of one or more SEQ ID NO: 99 through SEQ ID NO: 126.

In some embodiments, the genetically engineered bacteria comprise a gene cassette for the production of tryptamine from tryptophan. In some embodiments, the genetically engineered bacteria take up tryptophan through an endogenous or exogenous transporter as described above herein. In some embodiments the bacteria further produce tryptamine from tryptophan. In some embodiments, the genetically engineered bacteria optionally comprise a tryptamine exporter. In some embodiments the genetically engineered bacteria comprise an exporter of one or more indole metabolites, in order to increase the export of indole metabolites produced.

Indole 3-propionic acid (IPA)

In some embodiments, the genetically engineered bacteria comprise at least one genetic circuit for the production of indole-3-propionate (IPA). In some embodiments, the indole-3-propionate-producing strain optionally produces tryptophan from a chorismate precursor, and the strain optionally comprises additional circuits for tryptophan production and/or tryptophan uptake/transport s described herein. Additionally the genetically engineered bacteria comprise a circuit, comprising trpDH (Tryptophan dehydrogenase, e.g., from *Nostoc punctiforme* NIES-2108, which produces (indol-3yl)pyruvate from tryptophan), fldA (indole-3-propionyl-CoA:indole-3-lactate CoA transferase, e.g., from *Clostridium sporogenes*, which converts indole-3-lactate and indol-3-propionyl-CoA to indole-3-propionic acid and indole-3-lactate-CoA), fldB and fldC (indole-3-lactate dehydratase e.g., from *Clostridium sporogenes*, which converts indole-3-lactate-CoA to indole-3-acrylyl-CoA) fldD and/or AcuI: (indole-3-acrylyl-CoA reductase, e.g., from *Clostridium sporogenes* and/or acrylyl-CoA reductase, e.g., from *Rhodobacter sphaeroides*, which convert indole-3-acrylyl-CoA to indole-3-propionyl-CoA). The circuits further comprise fldH1 and/or fldH2 (indole-3-lactate dehydrogenase 1 and/or 2, e.g., from *Clostridium sporogenes*), which converts (indol-3-yl)pyruvate into indole-3-lactate) (see, e.g., FIG. 44).

Table 16 depicts non-limiting examples of contemplated polypeptide sequences, which are encoded by the indole-3-propionate producing bacteria.

TABLE 16

Non-limiting Examples of Sequences for indole-3-propionate Production

| Description | Sequence |
| --- | --- |
| FldA: indole-3-propionyl-CoA:indole-3-lactate CoA transferase from *Clostridium sporogenes* SEQ ID NO: 127 | MENNTNMFSGVKVIELANFIAAPAAGRFFADGGAEVIKIESPA GDPLRYTAPSEGRPLSQEENTTYDLENANKKAIVLNLKSEKGK KILHEMLAEADILLTNWRTKALVKQGLDYETLKEKYPKLVFA QITGYGEKGPDKDLPGFDYTAFFARGGVSGTLYEKGTVPPNV VPGLGDHQAGMFLAAGMAGALYKAKTTGQGDKVTVSLMHS AMYGLGIMIQAAQYKDHGLVYPINRNETPNPFIVSYKSKDDYF VQVCMPPYDVFYDRFMTALGREDLVGDERYNKIENLKDGRA KEVYSIIEQQMVTKTKDEWDKIFRDADIPFAIAQTWEDLLEDE QAWANDYLYKMKYPTGNERALVRLPVFFKEAGLPEYNQSPQI AENTVEVLKEMGYTEQEIEELEKDKDIMVRKEK |
| FldB: subunit of indole-3-lactate dehydratase from *Clostridium sporogenes* SEQ ID NO: 128 | MSDRNKEVKEKKAKHYLREITAKHYKEALEAKERGEKVGWC ASNFPQEIATTLGVKVVYPENHAAAVAARGNGQNMCEHAEA MGFSNDVCGYARVNLAVMDIGHSEDQPIPMPDFVLCCNNICN QMIKWYEHIAKTLDIPMILIDIPYNTENTVSQDRIKYIRAQFDD AIKQLEEITGKKWDENKFEEVMKISQESAKQWLRAASYAKYK PSPFSGFDLFNHMAVAVCARGTQEAADAFKMLADEYEENVKT GKSTYRGEEKQRILFEGIACWPYLRHKLTKLSEYGMNVTATV YAEAFGVIYENMDELMAAYNKVPNSISFENALKMRLNAVTST NTEGAVIHINRSCKLWSGFLYELARRLEKETGIPVVSFDGDQA DPRNFSEAQYDTRIQGLNEVMVAKKEAE |
| FldC: subunit of indole-3-lactate dehydratase from *Clostridium sporogenes* SEQ ID NO: 129 | MSNSDKFFNDFKDIVENPKKYIMKHMEQTGQKAIGCMPLYTP EELVLAAGMFPVGVWGSNTELSKAKTYFPAFICSILQTTLENA LNGEYDMLSGMMITNYCDSLKCMGQNFKLTVENIEFIPVTVPQ NRKMEAGKEFLKSQYKMNIEQLEKISGNKITDESLEKAIEIYDE HRKVMNDFSMLASKYPGIITPTKRNYVMKSAYYMDKKEHTE KVRQLMDEIKAIEPKPFEGKRVITTGIIADSEDLLKILEENNIAIV GDDIAHESRQYRTLTPEANTPMDRLAEQFANRECSTLYDPEKK RGQYIVEMAKERKADGIIFFMTKFCDPEEYDYPQMKKDFEEA GIPHVLIETDMQMKNYEQARTAIQAFSETL |
| FldD: indole-3-acrylyl-CoA reductase from *Clostridium sporogenes* SEQ ID NO: 130 | MFFTEQHELIRKLARDFAEQEIEPIADEVDKTAEFPKEIVKKMA QNGFFGIKMPKEYGGAGADNRAYVTIMEEISRASGVAGIYLSS PNSLLGTPFLLVGTDEQKEKYLKPMIRGEKTLAFALTEPGAGS DAGALATTAREEGDYYILNGRKTFITGAPISDNIIVFAKTDMSK GTKGITTFIVDSKQEGVSFGKPEDKMGMIGCPTSDIILENVKVH KSDILGEVNKGFITAMKTLSVGRIGVASQALGIAQAAVDEAVK YAKQRKQFNRPIAKFQAIQFKLANMETKLNAAKLLVYNAAYK MDCGEKADKEASMAKYFAAESAIQIVNDALQIHGGYGYIKDY KIERLYRDVRVIAIYEGTSEVQQMVIASNLLK |
| FldH1: indole-3-lactate dehydrogenase from *Clostridium sporogenes* SEQ ID NO: 131 | MKILAYCVRPDEVDSFKKFSEKYGHTVDLIPDSFGPNVAHLAK GYDGISILGNDTCNREALEKIKDCGIKYLATRTAGVNNIDFDA AKEFGINVANVPAYSPNSVSEFTIGLALSLTRKIPFALKRVELN NFALGGLIGVELRNLTLGVIGTGRIGLKVIEGFSGFGMKKMIGY DIFENEEAKKYIEYKSLDEVFKEADIITLHAPLTDDNYHMIGKE SIAKMKDGVFIINAARGALIDSEALIEGLKSGKIAGAALDSYEY EQGVFHNNKMNEIMQDDTLERLKSFPNVVITPHLGFYTDEAVS NMVEITLMNLQEFELKGTCKNQRVCK |
| FldH2: indole-3-lactate dehydrogenase from *Clostridium sporogenes* SEQ ID NO: 132 | MKILMYSVREHEKPAIKKWLEANPGVQIDLCNNALSEDTVCK AKEYDGIAIQQTNSIGGKAVYSTLKEYGIKQIASRTAGVDMIDL KMASDSNILVTNVPAYSPNAIAELAVTHTMNLLRNIKTLNKRI AYGDYRWSADLIAREVRSVTVGVVGTGKIGRTSAKLFKGLGA NVIGYDAYPDKKLEENNLLTYKESLEDLLREADVVTLHTPLLE STKYMINKNNLKYMKPDAFIVNTGRGGIINTEDLIEALEQNKIA GAALDTFENEGLFLNKVVDPTKLPDSQLDKLLKMDQVLITHH VGFFTTTAVQNIVDTSLDSVVEVLKTNNSVNKVN |

TABLE 16-continued

Non-limiting Examples of Sequences for
indole-3-propionate Production

| Description | Sequence |
|---|---|
| AcuI: acrylyl-CoA reductase from *Rhodobacter sphaeroides* SEQ ID NO: 133 | MRAVLIEKSDDTQSVSVTELAEDQLPEGDVLVDVAYSTLNYK DALAITGKAPVVRRFPMVPGIDFTGTVAQSSHADFKPGDRVIL NGWGVGEKHWGGLAERARVRGDWLVPLPAPLDLRQAAMIG TAGYTAMLCVLALERHGVVPGNGEIVVSGAAGGVGSVATTLL AAKGYEVAAVTGRASEAEYLRGLGAASVIDRNELTGKVRPLG QERWAGGIDVAGSTVLANMLSMMKYRGVVAACGLAAGMDL PASVAPFILRGMTLAGVDSVMCPKTDRLAAWARLASDLDPAK LEEMTTELPFSEVIETAPKFLDGTVRGRIVIPVTP |

In one embodiment, the tryptophan pathway catabolic enzyme has at least about 80% identity with the entire sequence of one or more of SEQ ID NO: 127 through SEQ ID NO: 133. In another embodiment, the tryptophan pathway catabolic enzyme has at least about 85% identity with the entire sequence of one or more SEQ ID NO: 127 through SEQ ID NO: 133. In one embodiment, the tryptophan pathway catabolic enzyme has at least about 90% identity with the entire sequence of one or more SEQ ID NO: 127 through SEQ ID NO: 133. In one embodiment, the tryptophan pathway catabolic enzyme has at least about 95% identity with the entire sequence of one or more SEQ ID NO: 127 through SEQ ID NO: 133. In another embodiment, the tryptophan pathway catabolic enzyme has at least about 96%, 97%, 98%, or 99% identity with the entire sequence of one or more SEQ ID NO: 127 through SEQ ID NO: 133. Accordingly, in one embodiment, the tryptophan pathway catabolic enzyme has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of one or more SEQ ID NO: 127 through SEQ ID NO: 133. In another embodiment, the tryptophan pathway catabolic enzyme comprises the sequence of one or more SEQ ID NO: 127 through SEQ ID NO: 133. In yet another embodiment the tryptophan pathway catabolic enzyme consists of the sequence of one or more SEQ ID NO: 127 through SEQ ID NO: 133.

In some embodiments, the genetically engineered bacteria comprise a gene cassette for the production of one or more indole pathway metabolites described herein from tryptophan or a tryptophan metabolite. In some embodiments, the genetically engineered bacteria take up tryptophan through an endogenous or exogenous transporter as described above herein. In some embodiments, the genetically engineered bacteria additionally produce tryptophan and/or chorismate through any of the pathways described herein, e.g. FIG. 39, FIG. 45A and FIG. 45B. In some embodiments the genetically engineered bacteria comprise an exporter of one or more indole metabolites, in order to increase the export of indole metabolites produced.

In some embodiments, the genetically engineered bacteria are capable of expressing any one or more of the described circuits in low-oxygen conditions, in the presence of disease or tissue specific molecules or metabolites, in the presence of molecules or metabolites associated with inflammation or an inflammatory response or immune suppression or in the presence of some other metabolite that may or may not be present in the gut, such as arabinose or tetracycline. In some embodiments, any one or more of the described circuits are present on one or more plasmids (e.g., high copy or low copy) or are integrated into one or more sites in the bacterial chromosome. In some embodiments, the tryptophan synthesis and/or tryptophan catabolism cassette(s) is under control of an inducible promoter. Exemplary inducible promoters which may control the expression of the at least one sequence(s) include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline.

Also, in some embodiments, the genetically engineered bacteria are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more exporters for exporting biological molecules or substrates, such any of the exporters described herein or otherwise known in the art, (6) one or more secretion circuits, such as any of the secretion circuits described herein and otherwise known in the art, and (7) combinations of one or more of such additional circuits.

Tryptophan Repressor (TrpR)

In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC.

Tryptophan and Tryptophan Metabolite Transport

Metabolite transporters may further be expressed or modified in the genetically engineered bacteria of the invention in order to enhance tryptophan or KP metabolite transport into the cell.

The inner membrane protein YddG of *E. coli*, encoded by the yddG gene, is a homologue of the known amino acid exporters RhtA and YdeD. Studies have shown that YddG is capable of exporting aromatic amino acids, including tryptophan. Thus, YddG can function as a tryptophan exporter or a tryptophan secretion system (or tryptophan secretion protein). Other aromatic amino acid exporters are described in Doroshenko et al., FEMS Microbiol. Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

In some embodiments, the engineered microbe has a mechanism for importing (transporting) Kynurenine from the local environment into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments the genetically engineered bacteria comprise a transporter to facilitate uptake of tryptophan into the cell. Three permeases, Mtr, TnaB, and AroP, are involved in the uptake of L-tryptophan in *Escherichia coli*. In some embodiments, the genetically engineered bacteria comprise one or more copies of one or more of Mtr, TnaB, and AroP.

In some embodiments, the genetically engineered bacteria of the invention also comprise multiple copies of the transporter gene. In some embodiments, the genetically engineered bacteria of the invention also comprise a transporte gene from a different bacterial species. In some embodiments, the genetically engineered bacteria of the invention comprise multiple copies of a transporter gene from a different bacterial species. In some embodiments, the native transporter gene in the genetically engineered bacteria of the invention is not modified. In some embodiments, the genetically engineered bacteria of the invention comprise a transporter gene that is controlled by its native promoter, an inducible promoter, or a promoter that is stronger than the native promoter, e.g., a GlnRS promoter, a P(Bla) promoter, or a constitutive promoter.

In some embodiments, the native transporter gene in the genetically engineered bacteria is not modified, and one or more additional copies of the native transporter gene are inserted into the genome under the control of the same inducible promoter that controls expression of the payload, e.g., a FNR promoter, or a different inducible promoter than the one that controls expression of the payload or a constitutive promoter. In alternate embodiments, the native transporter gene is not modified, and a copy of a non-native transporter gene from a different bacterial species is inserted into the genome under the control of the same inducible promoter that controls expression of the payload, e.g., a FNR promoter, or a different inducible promoter than the one that controls expression of the payload or a constitutive promoter.

In some embodiments, the native transporter gene in the genetically engineered bacteria is not modified, and one or more additional copies of the native transporter gene are present in the bacteria on a plasmid and under the control of the same inducible promoter that controls expression of the payload e.g., a FNR promoter, or a different inducible promoter than the one that controls expression of the payload or a constitutive promoter. In alternate embodiments, the native transporter gene is not modified, and a copy of a non-native transporter gene from a different bacterial species is present in the bacteria on a plasmid and under the control of the same inducible promoter that controls expression of the payload, e.g., a FNR promoter, or a different inducible promoter than the one that controls expression of the payload or a constitutive promoter.

In some embodiments, the native transporter gene is mutagenized, the mutants exhibiting increased ammonia transport are selected, and the mutagenized transporter gene is isolated and inserted into the genetically engineered bacteria. In some embodiments, the native transporter gene is mutagenized, mutants exhibiting increased ammonia transport are selected, and those mutants are used to produce the bacteria of the invention. The transporter modifications described herein may be present on a plasmid or chromosome.

In some embodiments, the genetically engineered bacterium is *E. coli* Nissle, and the native transporter gene in *E. coli* Nissle is not modified; one or more additional copies the native *E. coli* Nissle transporter genes are inserted into the *E. coli* Nissle genome under the control of the same inducible promoter that controls expression of the payload e.g., a FNR promoter, or a different inducible promoter than the one that controls expression of the payload or a constitutive promoter. In an alternate embodiment, the native transporter gene in *E. coli* Nissle is not modified, and a copy of a non-native transporter gene from a different bacterium, e.g., *Lactobacillus plantarum*, is inserted into the *E. coli* Nissle genome under the control of the same inducible promoter that controls expression of the payload, e.g., a FNR promoter, or a different inducible promoter than the one that controls expression of the payload or a constitutive promoter.

In some embodiments, the genetically engineered bacterium is *E. coli* Nissle, and the native transporter gene in *E. coli* Nissle is not modified; one or more additional copies the native *E. coli* Nissle transporter genes are present in the bacterium on a plasmid and under the control of the same inducible promoter that controls expression of the payload, e.g., a FNR promoter, or a different inducible promoter than the one that controls expression of the payload, or a constitutive promoter. In an alternate embodiment, the native transporter gene in *E. coli* Nissle is not modified, and a copy of a non-native transporter gene from a different bacterium, e.g., *Lactobacillus plantarum*, are present in the bacterium on a plasmid and under the control of the same inducible promoter that controls expression of the payload, e.g., a FNR promoter, or a different inducible promoter than the one that controls expression of the payload, or a constitutive promoter.

Secreted Polypeptides

IL-10

In some embodiments, the genetically engineered bacteria of the invention are capable of producing IL-10. Interleukin-10 (IL-10) is a class 2 cytokine, a category which includes cytokines, interferons, and interferon-like molecules, such as IL-19, IL-20, IL-22, IL-24, IL-26, IL-28A, IL-28B, IL-29, IFN-α, IFN-β, IFN-δ, IFN-ε, IFN-κ, IFN-τ, IFN-ω, and limitin. IL-10 is an anti-inflammatory cytokine that signals through two receptors, IL-10R1 and IL-10R2. Anti-inflammatory properties of human IL-10 include down-regulation of pro-inflammatory cytokines, inhibition of antigen presentation on dendritic cells or suppression of major histocompatibility complex expression. Deficiencies in IL-10 and/or its receptors are associated with IBD and intestinal sensitivity (Nielsen, 2014). Bacteria expressing IL-10 or protease inhibitors may ameliorate conditions such as Crohn's disease and ulcerative colitis (Simpson et al., 2014). The genetically engineered bacteria may comprise any suitable gene encoding IL-10, e.g., human IL-10. In some embodiments, the gene encoding IL-10 is modified and/or mutated, e.g., to enhance stability, increase IL-10 production, and/or increase anti-inflammatory potency under inducing conditions. In some embodiments, the genetically engineered bacteria are capable of producing IL-10 under inducing conditions, e.g., under a condition(s) associated with inflammation. In some embodiments, the genetically engineered bacteria are capable of producing IL-10 in low-oxygen conditions. In some embodiments, the genetically engineered bacteria comprise a nucleic acid sequence that encodes IL-10. In some embodiments, the genetically engineered bacteria comprise a nucleic acid sequence comprising SEQ ID NO: 134 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence comprising SEQ ID NO: 49 or a functional fragment thereof.

TABLE 17

IL-10 (SEQ ID NO: 134):

ATGAGCCCCGGACAGGGAACTCAAAGCGAGAACAGCTGCACACATTTTCC

AGGTAATCTTCCAAATATGCTTCGTGACTTGCGTGACGCTTTCTCTCGCG

TGAAAACCTTTTTTCAGATGAAGGATCAGTTAGATAATCTGCTGCTGAAA

GAATCGCTTCTTGAGGACTTCAAGGGATATCTGGGATGTCAGGCGTTATC

TGAGATGATTCAGTTTTATTTGGAAGAAGTTATGCCCCAGGCTGAGAATC

AAGACCCTGACATCAAAGCGCATGTGAATAGCCTGGGCGAGAATCTGAAG

ACACTGCGCCTGCGTCTTCGCCGCTGTCACCGTTTTCTGCCTTGCGAAAA

TAAGAGTAAGGCCGTTGAGCAAGTGAAAAATGCTTTCAACAAGTTACAAG

AAAAAGGGATTTACAAAGCTATGTCTGAGTTTGACATTTTCATTAATTAC

ATTGAGGCCTACATGACTATGAAGATTCGCAAT

Wild type IL-10 (wtIL-10) is a domain swapped dimer whose structural integrity depends on the dimerization of two peptide chains. wtIL-10 was converted to a monomeric isomer by inserting 6 amino acids into the loop connecting the swapped secondary structural elements (see, e.g., Josephson, K. et al. Design and analysis of an engineered human interleukin-10 monomer. J. Biol. Chem. 275, 13552-13557 (2000), and Yoon, S. I. et al. Epstein-Barr Virus IL-10 Engages IL-10R1 by a Two-step Mechanism Leading to Altered Signaling Properties. J. Biol. Chem. 287, 26586-26595 (2012). Monomoerized IL-10 therefore comprises a small linker which deviates from the wild-type human IL-10 sequence. This linker causes the IL10 to become active as a monomer rather than a dimer (see, e.g., Josephson, K. et al. Design and analysis of an engineered human interleukin-10 monomer. J. Biol. Chem. 275, 13552-13557 (2000), and Yoon, S. I. et al. Epstein-Barr Virus IL-10 Engages IL-10R1 by a Two-step Mechanism Leading to Altered Signaling Properties. J. Biol. Chem. 287, 26586-26595 (2012)).

Secretion of a monomeric protein may have advantages, avoiding the extra step of dimerization in the periplasmic space. Moreover, there is more flexibility in the selection of appropriate secretion systems. For example, the tat-dependent secretion system secretes polypeptides in a folded fashion. Dimers cannot fold correctly without the formation of disulfide bonds. Disulfide bonds, however, cannot form in the reducing intracellular environment and require the oxidizing environment of the periplasm to form. Therefore, the tat-dependent system may no be appropriate for the secretion of proteins which require dimerization to function properly.

In some embodiments, the genetically engineered bacteria of the invention are capable of producing monomerized human IL-10. In some embodiments, the genetically engineered bacteria are capable of producing monomerized IL-10 under inducing conditions, e.g., under a condition(s) associated with inflammation. In some embodiments, the genetically engineered bacteria are capable of producing monomerized IL-10 in low-oxygen conditions. In some embodiments, the genetically engineered bacteria comprise a nucleic acid sequence that encodes monomerized IL-10. In some embodiments, the genetically engineered bacteria comprise a nucleic acid sequence comprising SEQ ID NO: 198 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence comprising SEQ ID NO: 198 or a functional fragment thereof. In some embodiments, the genetically engineered bacteria comprise a sequence which encodes the polypeptide encoded by SEQ ID NO: 198 or a fragment or functional variant thereof. In some embodiments, the monomerized IL-10 expressed by the bacteria stimulates IL-10R1 and IL-10R2 and initiates signal transduction. Signaling includes Stat signaling, e.g. through the phosphorylation of Tyr705 and/or Ser727.

In some embodiments, the genetically engineered bacteria of the invention are capable of producing viral IL-10. Exemplary viral IL-10 homologues encoded by the bacteria include human cytomegalo-(HCMV) and Epstein-Barr virus (EBV) IL-10. Apart from its anti-inflammatory effects, human IL-10 also possesses pro-inflammatory activity, e.g., stimulation of B-cell maturation and proliferation of natural killer cells (Foerster et al., Secretory expression of biologically active human Herpes virus interleukin-10 analogues in *Escherichia coli* via a modified Sec-dependent transporter construct, BMC Biotechnol. 2013; 13: 82, and references therein). In contrast, viral IL-10 homologues share many biological activities of hIL-10 but, due to selective pressure during virus evolution and the need to escape the host immune system, also display unique traits, including increased stability and lack of immunostimulatory functions (Foerster et al, and references therein). As such, viral counterparts may be useful and possibly more effective than hIL-10 with respect to anti-inflammatory and/or immune suppressing effects.

In some embodiments, the genetically engineered bacteria are capable of producing viral IL-10 under inducing conditions, e.g., under a condition(s) associated with inflammation. In some embodiments, the genetically engineered bacteria are capable of producing viral IL-10 in low-oxygen conditions. In some embodiments, the genetically engineered bacteria comprise a nucleic acid sequence that encodes viral IL-10. In some embodiments, the genetically engineered bacteria comprise a nucleic acid sequence comprising SEQ ID NO: 193 and/or SEQ ID NO: 194 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence comprising SEQ ID NO: 193 and/or SEQ ID NO: 194 or a functional fragment thereof. In some embodiments, the viral d IL-10 expressed by the bacteria stimulates IL-10R1 and IL-10R2 and initiates signal transduction. Signaling includes Stat signaling, e.g. through the phosphorylation of Tyr705 and/or Ser727.

IL-2

In some embodiments, the genetically engineered bacteria are capable of producing IL-2. Interleukin 2 (IL-2) mediates autoimmunity by preserving health of regulatory T cells (Treg). Treg cells, including those expressing Foxp3, typically suppress effector T cells that are active against self-antigens, and in doing so, can dampen autoimmune activity.

IL-2 functions as a cytokine to enhance Treg cell differentiation and activity while diminished IL-2 activity can promote autoimmunity events. IL-2 is generated by activated CD4+ T cells, and by other immune mediators including activated CD8+ T cells, activated dendritic cells, natural killer cells, and NK T cells. IL-2 binds to IL-2R, which is composed of three chains including CD25, CD122, and CD132. IL-2 promotes growth of Treg cells in the thymus, while preserving their function and activity in systemic circulation. Treg cell activity plays an intricate role in the IBD setting, with murine studies suggesting a protective role in disease pathogenesis. In some embodiments, the genetically engineered bacteria comprise a nucleic acid sequence encoding SEQ ID NO: 135 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence encoding SEQ ID NO: 135 or a functional fragment thereof. In some embodiments, the genetically engineered bacteria are capable of producing IL-2 under inducing conditions, e.g., under a condition(s) associated with inflammation. In some embodiments, the genetically engineered bacteria are capable of producing IL-2 in low-oxygen conditions.

TABLE 18

SEQ ID NO: 135
SEQ ID NO: 135

MAPTSSSTKK TQLQLEHLLL DLQMILNGIN NYKNPKLTRM

LTFKFYMPKK ATELKHLQCL EEELKPLEEV LNLAQSKNFH

LRPRDLISNI NVIVLELKGS ETTFMCEYAD ETATIVEFLN

RWITFCQSII STLT

IL-22

In some embodiments, the genetically engineered bacteria are capable of producing IL-22. Interleukin 22 (IL-22) cytokine can be produced by dendritic cells, lymphoid tissue inducer-like cells, natural killer cells and expressed on adaptive lymphocytes. Through initiation of Jak-STAT signaling pathways, IL-22 expression can trigger expression of antimicrobial compounds as well as a range of cell growth related pathways, both of which enhance tissue repair mechanisms. IL-22 is critical in promoting intestinal barrier fidelity and healing, while modulating inflammatory states. Murine models have demonstrated improved intestinal inflammation states following administration of Il-22. Additionally, IL-22 activates STAT3 signaling to promote enhanced mucus production to preserve barrier function. IL-22's association with IBD susceptibility genes may modulate phenotypic expression of disease as well. In some embodiments, the genetically engineered bacteria comprise a nucleic acid sequence encoding SEQ ID NO: 136 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence encoding SEQ ID NO: 136 or a functional fragment thereof. In some embodiments, the genetically engineered bacteria are capable of producing IL-22 under inducing conditions, e.g., under a condition(s) associated with inflammation. In some embodiments, the genetically engineered bacteria are capable of producing IL-22 in low-oxygen conditions.

TABLE 19

SEQ ID NO: 136
SEQ ID NO: 136

MAALQKSVSS FLMGTLATSC LLLLALLVQG GAAAPISSHC

RLDKSNFQQP YITNRTFMLA KEASLADNNT DVRLIGEKLF

HGVSMSERCY LMKQVLNFTL EEVLFPQSDR FQPYMQEVVP

FLARLSNRLS TCHIEGDDLH IQRNVQKLKD TVKKLGESGE

IKAIGELDLL FMSLRNACI

IL-27

In some embodiments, the genetically engineered bacteria are capable of producing IL-27. Interleukin 27 (IL-27) cytokine is predominately expressed by activated antigen presenting cells, while IL-27 receptor is found on a range of cells including T cells, NK cells, among others. In particular, IL-27 suppresses development of pro-inflammatory T helper 17 (Th17) cells, which play a critical role in IBD pathogenesis. Further, IL-27 can promote differentiation of IL-10 producing Tr1 cells and enhance IL-10 output, both of which have anti-inflammatory effects. IL-27 has protective effects on epithelial barrier function via activation of MAPK and STAT signaling within intestinal epithelial cells. Additionally, IL-27 enhances production of antibacterial proteins that curb bacterial growth. Improvement in barrier function and reduction in bacterial growth suggest a favorable role for IL-27 in IBD pathogenesis. In some embodiments, the genetically engineered bacteria comprise a nucleic acid sequence encoding SEQ ID NO: 137 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence encoding SEQ ID NO: 137 or a functional fragment thereof. In some embodiments, the genetically engineered bacteria are capable of producing IL-27 under inducing conditions, e.g., under a condition(s) associated with inflammation. In some embodiments, the genetically engineered bacteria are capable of producing IL-27 in low-oxygen conditions.

TABLE 20

SEQ ID NO: 137
SEQ ID NO: 137

MGQTAGDLGW RLSLLLLPLL LVQAGVWGFP RPPGRPQLSL

QELRREFTVS LHLARKLLSE VRGQAHRFAE SHLPGVNLYL

LPLGEQLPDV SLTFQAWRRL SDPERLCFIS TTLQPFHALL

GGLGTQGRWT NMERMQLWAM RLDLRDLQRH LRFQVLAAGF

NLPEEEEEEE EEEEEERKGL LPGALGSALQ GPAQVSWPQL

LSTYRLLHSL ELVLSRAVRE LLLLSKAGHS VWPLGFPTLS PQP

SOD

In some embodiments, the genetically engineered bacteria of the invention are capable of producing SOD. Increased ROS levels contribute to pathophysiology of inflammatory bowel disease. Increased ROS levels may lead to enhanced expression of vascular cell adhesion molecule 1 (VCAM-1), which can facilitate translocation of inflammatory mediators to disease affected tissue, and result in a greater degree of inflammatory burden. Antioxidant systems including superoxide dismutase (SOD) can function to mitigate overall ROS burden. However, studies indicate that the expression of SOD in the setting of IBD may be compromised, e.g., produced at lower levels in IBD, thus allowing disease pathology to proceed. Further studies have shown that supplementation with SOD to rats within a colitis model is associated with reduced colonic lipid peroxidation and endothelial VCAM-1 expression as well as overall improvement in inflammatory environment. Thus, in some embodiments, the genetically engineered bacteria comprise a nucleic acid sequence encoding SEQ ID NO: 138 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence encoding SEQ ID NO: 138 or a functional fragment thereof. In some embodiments, the genetically engineered bacteria are capable of producing SOD under inducing conditions, e.g., under a condition(s) associated with inflammation. In some embodiments, the genetically engineered bacteria are capable of producing SOD in low-oxygen conditions.

TABLE 21

SEQ ID NO: 138
SEQ ID NO: 138

MATKAVCVLK GDGPVQGIIN FEQKESNGPV KVWGSIKGLT

EGLHGFHVHE FGDNTAGCTS AGPHFNPLSR KHGGPKDEER

HVGDLGNVTA DKDGVADVSI EDSVISLSGD HCIIGRTLVV

HEKADDLGKG GNEESTKTGN AGSRLACGVI GIAQ

GLP2

In some embodiments, the genetically engineered bacteria are capable of producing GLP-2 or proglucagon. Glucagon-like peptide 2 (GLP-2) is produced by intestinal endocrine cells and stimulates intestinal growth and enhances gut barrier function. GLP-2 administration has therapeutic potential in treating IBD, short bowel syndrome, and small bowel enteritis (Yazbeck et al., 2009). The genetically engineered bacteria may comprise any suitable gene encoding GLP-2 or proglucagon, e.g., human GLP-2 or proglucagon. In some embodiments, a protease inhibitor, e.g., an inhibitor of dipeptidyl peptidase, is also administered to decrease GLP-2 degradation. In some embodiments, the genetically engineered bacteria express a degradation resistant GLP-2 analog, e.g., Teduglutide (Yazbeck et al., 2009). In some embodiments, the gene encoding GLP-2 or proglucagon is modified and/or mutated, e.g., to enhance stability, increase GLP-2 production, and/or increase gut barrier enhancing potency under inducing conditions. In some embodiments, the genetically engineered bacteria of the invention are capable of producing GLP-2 or proglucagon under inducing conditions. GLP-2 administration in a murine model of IBD is associated with reduced mucosal damage and inflammation, as well as a reduction in inflammatory mediators, such as TNF-α and IFN-γ. Further, GLP-2 supplementation may also lead to reduced mucosal myeloperoxidase in colitis/ileitis models. In some embodiments, the genetically engineered bacteria comprise a nucleic acid sequence encoding SEQ ID NO: 139 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence encoding SEQ ID NO: 139 or a functional fragment thereof. In some embodiments, the genetically engineered bacteria are capable of producing GLP-2 under inducing conditions, e.g., under a condition(s) associated with inflammation. In some embodiments, the genetically engineered bacteria are capable of producing GLP-2 in low-oxygen conditions.

TABLE 22

SEQ ID NO: 139 GLP-2
SEQ ID NO: 139

HADGSFSDEMNTILDNLAARDFINWLIQTKITD

In some embodiments, the genetically engineered bacteria are capable of producing GLP-2 analogs, including but not limited to, Gattex and teduglutide. Teduglutide is a protease resistant analog of GLP-2. It is made up of 33 amino acids and differs from GLP-2 by one amino acid (alanine is substituted by glycine). The significance of this substitution is that teduglutide is longer acting than endogenous GLP-2 as it is more resistant to proteolysis from dipeptidyl peptidase-4.

TABLE 23

SEQ ID NO: 140 Teduglutide
SEQ ID NO: 140

HGDGSFSDEMNTILDNLAARDFINWLIQTKITD

In some embodiments, the genetically engineered bacteria comprise a nucleic acid sequence encoding SEQ ID NO: 140 or a functional fragment thereof. In some embodiments, genetically engineered bacteria comprise a nucleic acid sequence that is at least about 80%, at least about 85%, at least about 90%, at least about 95%, or at least about 99% homologous to a nucleic acid sequence encoding SEQ ID NO: 140 or a functional fragment thereof. In some embodiments, the genetically engineered bacteria are capable of producing Teduglutide under inducing conditions, e.g., under a condition(s) associated with inflammation. In some embodiments, the genetically engineered bacteria are capable of producing Teduglutide in low-oxygen conditions.

IL-19, IL-20, and/or IL-24

In some embodiments, the genetically engineered bacteria are capable of producing IL-19, IL-20, and/or IL-24. In some embodiments, the genetically engineered bacteria are capable of producing IL-19, IL-20, and/or IL-24 under inducing conditions, e.g., under a condition(s) associated with inflammation. In some embodiments, the genetically engineered bacteria are capable of producing IL-19, IL-20 and/or IL-24 in low-oxygen conditions.

Inhibition of Pro-Inflammatory Molecules

In some embodiments, the genetically engineered bacteria of the invention are capable of producing a molecule that is capable of inhibiting a pro-inflammatory molecule. The genetically engineered bacteria may express any suitable inhibitory molecule, e.g., a single-chain variable fragment (scFv), antisense RNA, siRNA, or shRNA, that is capable of neutralizing one or more pro-inflammatory molecules, e.g., TNF, IFN-γ, IL-1β, IL-6, IL-8, IL-17, IL-18, IL-21, IL-23, IL-26, IL-32, Arachidonic acid, prostaglandins (e.g., $PGE_2$), $PGI_2$, serotonin, thromboxanes (e.g., $TXA_2$), leukotrienes (e.g., $LTB_4$), hepoxillin $A_3$, or chemokines (Keates et al., 2008; Ahmad et al., 2012). The genetically engineered bacteria may inhibit one or more pro-inflammatory molecules, e.g., TNF, IL-17. In some embodiments, the genetically engineered bacteria are capable of modulating one or more molecule(s) shown in Table 24. In some embodiments, the genetically engineered bacteria are capable of inhibiting, removing, degrading, and/or metabolizing one or more inflammatory molecules.

In some embodiments, the genetically engineered bacteria are capable of producing an anti-inflammation and/or gut barrier enhancer molecule and further producing a molecule that is capable of inhibiting an inflammatory molecule. In some embodiments, the genetically engineered bacteria of the invention are capable of producing an anti-inflammation and/or gut barrier enhancer molecule and further producing an enzyme that is capable of degrading an inflammatory

TABLE 24

| Metabolites | Related bacteria | Potential biological functions |
| --- | --- | --- |
| Bile acids: cholate, hyocholate, deoxycholate, chenodeoxycholate, a-muricholate, b-muricholate, w-muricholate, taurocholate, glycocholate, taurochenoxycholate, glycochenodeoxycholate, taurocholate, tauro-a-muricholate, tauro-b-muricholate, lithocholate, ursodeoxycholate, hyodeoxycholate, glycodeoxylcholate | *Lactobacillus*, *Bifidobacteria*, *Enterobacter*, *Bacteroides*, *Clostridium* | Absorb dietary fats and lipid-soluble vitamins, facilitate lipid absorption, maintain intestinal barrier function, signal systemic endocrine functions to regulate triglycerides, cholesterol, glucose and energy homeostasis. |
| Choline metabolites: methylamine, dimethylamine, trimethylamine, trimethylamine-N-oxide, dimethylglycine, betaine | *Faecalibacterium prausnitzii*, *Bifidobacterium* | Modulate lipid metabolism and glucose homeostasis. Involved in nonalcoholic fatty liver disease, dietary induced obesity, diabetes, and cardiovascular disease. |
| Phenolic, benzoyl, and phenyl derivatives: benzoic acid, hippuric acid, 2-hydroxyhippuric acid, 2-hydroxybenzoic acid, 3-hydroxyhippuric acid, 3-hydroxybenzoic acid, 4 hydroxybenzoic acid, 3hydroxyphenylpropionate, 4-hydroxyphenylpropionate, 3-hydroxycinnamate, 4-methylphenol, tyrosine, phenylalanine, 4-cresol, 4-cresyl sulfate, 4-cresyl glucuronide, 4-hydroxyphenylacetate | *Clostridium difficile*, *F. prausnitzii*, *Bifidobacterium*, *Subdoligranulum*, *Lactobacillus* | Detoxification of xenobiotics; indicate gut microbial composition and activity; utilize polyphenols. Urinary hippuric acid may be a biomarker of hypertension and obesity in humans. Urinary 4-hydroxyphenylacetate, 4-cresol, and phenylacetate are elevated in colorectal cancer. Urinary 4-cresyl sulfate is elevated in children with severe autism. |
| Indole derivatives: N-acetyltryptophan, indoleacetate, indoleacetylglycine (IAG), indole, indoxyl sulfate, indole-3-propionate, melatonin, melatonin 6-sulfate, serotonin, 5-hydroxyindole | *Clostridium sporogenes*, *E. coli* | Protect against stress-induced lesions in the GI tract; modulate expression of proinflammatory genes, increase expression of anti-inflammatory genes, strengthen epithelial cell barrier properties. Implicated in GI pathologies, brain-gut axis, and a few neurological conditions. |
| Vitamins: vitamin K, vitamin B12, biotin, folate, thiamine, riboflavin, pyridoxine | *Bifidobacterium* | Provide complementary endogenous sources of vitamins, strengthen immune function, exert epigenetic effects to regulate cell proliferation. |
| Polyamines: putrescine, cadaverine, spermidine, spermine | *Campylobacter jejuni*, *Clostridium saccharolyticum* | Exert genotoxic effects on the host, anti-inflammatory and antitumoral effects. Potential tumor markers. |
| Lipids: conjugated fatty acids, LPS, peptidoglycan, acylglycerols, sphingomyelin, cholesterol, phosphatidylcholines, phosphoethanolamines, triglycerides | *Bifidobacterium*, *Roseburia*, *Lactobacillus*, *Klebsiella*, *Enterobacter*, *Citrobacter*, *Clostridium* | Impact intestinal permeability, activate intestinebrain- liver neural axis to regulate glucose homeostasis; LPS induces chronic systemic inflammation; conjugated fatty acids improve hyperinsulinemia, enhance the immune system and alter lipoprotein profiles. |
| Others: D-lactate, formate, methanol, ethanol, succinate, lysine, glucose, urea, a-ketoisovalerate, creatine, creatinine, endocannabinoids, 2-arachidonoylglycerol (2-AG), N-arachidonoylethanolamide, LPS | *Bacteroides*, *Pseudobutyrivibrio*, *Ruminococcus*, *Faecalibacterium* | Direct or indirect synthesis or utilization of compounds or modulation of linked pathways including endocannabinoid system. | molecule. For example, the genetically engineered bacteria of the invention are capable of expressing a gene cassette for producing butyrate, as well as a molecule or biosynthetic pathway for inhibiting, removing, degrading, and/or metabolizing an inflammatory molecule, e.g., $PGE_2$.

RNAi, scFV, Other Mechanisms

RNA interference (RNAi) is a post-transcriptional gene silencing mechanism in plants and animals. RNAi is activated when microRNA (miRNA), double-stranded RNA (dsRNA), or short hairpin RNA (shRNA) is processed into short interfering RNA (siRNA) duplexes (Keates et al., 2008). RNAi can be "activated in vitro and in vivo by non-pathogenic bacteria engineered to manufacture and deliver shRNA to target cells" such as mammalian cells (Keates et al., 2008). In some embodiments, the genetically engineered bacteria of the invention induce RNAi-mediated gene silencing of one or more pro-inflammatory molecules in low-oxygen conditions. In some embodiments, the genetically engineered bacteria produce siRNA targeting TNF in low-oxygen conditions.

Single-chain variable fragments (scFv) are "widely used antibody fragments . . . produced in prokaryotes" (Frenzel et al., 2013). scFv lacks the constant domain of a traditional antibody and expresses the antigen-binding domain as a single peptide. Bacteria such as *Escherichia coli* are capable of producing scFv that target pro-inflammatory cytokines, e.g., TNF (Hristodorov et al., 2014). In some embodiments, the genetically engineered bacteria of the invention express a binding protein for neutralizing one or more pro-inflammatory molecules in low-oxygen conditions. In some embodiments, the genetically engineered bacteria produce scFv targeting TNF in low-oxygen conditions. In some embodiments, the genetically engineered bacteria produce both scFv and siRNA targeting one or more pro-inflammatory molecules in low-oxygen conditions (see, e.g., Xiao et al., 2014).

One of skill in the art would appreciate that additional genes and gene cassettes capable of producing anti-inflammation and/or gut barrier function enhancer molecules are known in the art and may be expressed by the genetically engineered bacteria of the invention. In some embodiments, the gene or gene cassette for producing a therapeutic molecule also comprises additional transcription and translation elements, e.g., a ribosome binding site, to enhance expression of the therapeutic molecule.

In some embodiments, the genetically engineered bacteria produce two or more anti-inflammation and/or gut barrier function enhancer molecules. In certain embodiments, the two or more molecules behave synergistically to reduce gut inflammation and/or enhance gut barrier function. In some embodiments, the genetically engineered bacteria express at least one anti-inflammation molecule and at least one gut barrier function enhancer molecule. In certain embodiments, the genetically engineered bacteria express IL-10 and GLP-2. In alternate embodiments, the genetically engineered bacteria express IL-10 and butyrate.

In some embodiments, the genetically engineered bacteria are capable of producing IL-2, IL-10, IL-22, IL-27, propionate, and butyrate. In some embodiments, the genetically engineered bacteria are capable of producing IL-10, IL-27, GLP-2, and butyrate. In some embodiments, the genetically engineered bacteria are capable of producing GLP-2, IL-10, IL-22, SOD, butyrate, and propionate. In some embodiments, the genetically engineered bacteria are capable of GLP-2, IL-2, IL-10, IL-22, IL-27, SOD, butyrate, and propionate. Any suitable combination of therapeutic molecules may be produced by the genetically engineered bacteria.

Generation of Bacterial Strains with Enhance Ability to Transport Amino Acids

Due to their ease of culture, short generation times, very high population densities and small genomes, microbes can be evolved to unique phenotypes in abbreviated timescales. Adaptive laboratory evolution (ALE) is the process of passaging microbes under selective pressure to evolve a strain with a preferred phenotype. Most commonly, this is applied to increase utilization of carbon/energy sources or adapting a strain to environmental stresses (e.g., temperature, pH), whereby mutant strains more capable of growth on the carbon substrate or under stress will outcompete the less adapted strains in the population and will eventually come to dominate the population.

This same process can be extended to any essential metabolite by creating an auxotroph. An auxotroph is a strain incapable of synthesizing an essential metabolite and must therefore have the metabolite provided in the media to grow. In this scenario, by making an auxotroph and passaging it on decreasing amounts of the metabolite, the resulting dominant strains should be more capable of obtaining and incorporating this essential metabolite.

For example, if the biosynthetic pathway for producing an amino acid is disrupted a strain capable of high-affinity capture of said amino acid can be evolved via ALE. First, the strain is grown in varying concentrations of the auxotrophic amino acid, until a minimum concentration to support growth is established. The strain is then passaged at that concentration, and diluted into lowering concentrations of the amino acid at regular intervals. Over time, cells that are most competitive for the amino acid—at growth-limiting concentrations—will come to dominate the population. These strains will likely have mutations in their amino acid-transporters resulting in increased ability to import the essential and limiting amino acid.

Similarly, by using an auxotroph that cannot use an upstream metabolite to form an amino acid, a strain can be evolved that not only can more efficiently import the upstream metabolite, but also convert the metabolite into the essential downstream metabolite. These strains will also evolve mutations to increase import of the upstream metabolite, but may also contain mutations which increase expression or reaction kinetics of downstream enzymes, or that reduce competitive substrate utilization pathways.

A metabolite innate to the microbe can be made essential via mutational auxotrophy and selection applied with growth-limiting supplementation of the endogenous metabolite. However, phenotypes capable of consuming non-native compounds can be evolved by tying their consumption to the production of an essential compound. For example, if a gene from a different organism is isolated which can produce an essential compound or a precursor to an essential compound this gene can be recombinantly introduced and expressed in the heterologous host. This new host strain will now have the ability to synthesize an essential nutrient from a previously non-metabolizable substrate.

Hereby, a similar ALE process can be applied by creating an auxotroph incapable of converting an immediately downstream metabolite and selecting in growth-limiting amounts of the non-native compound with concurrent expression of the recombinant enzyme. This will result in mutations in the transport of the non-native substrate, expression and activity of the heterologous enzyme and expression and activity of downstream native enzymes. It should be emphasized that the key requirement in this process is the ability to tether the consumption of the non-native metabolite to the production of a metabolite essential to growth.

Once the basis of the selection mechanism is established and minimum levels of supplementation have been established, the actual ALE experimentation can proceed. Throughout this process several parameters must be vigilantly monitored. It is important that the cultures are maintained in an exponential growth phase and not allowed to reach saturation/stationary phase. This means that growth rates must be check during each passaging and subsequent dilutions adjusted accordingly. If growth rate improves to such a degree that dilutions become large, then the concentration of auxotrophic supplementation should be decreased such that growth rate is slowed, selection pressure is increased and dilutions are not so severe as to heavily bias subpopulations during passaging. In addition, at regular intervals cells should be diluted, grown on solid media and individual clones tested to confirm growth rate phenotypes observed in the ALE cultures.

Predicting when to halt the stop the ALE experiment also requires vigilance. As the success of directing evolution is tied directly to the number of mutations "screened" throughout the experiment and mutations are generally a function of errors during DNA replication, the cumulative cell divisions (CCD) acts as a proxy for total mutants which have been screened. Previous studies have shown that beneficial phenotypes for growth on different carbon sources can be isolated in about 1011.2 CCD1. This rate can be accelerated by the addition of chemical mutagens to the cultures—such as N-methyl-N-nitro-N-nitrosoguanidine (NTG)—which causes increased DNA replication errors. However, when continued passaging leads to marginal or no improvement in growth rate the population has converged to some fitness maximum and the ALE experiment can be halted.

At the conclusion of the ALE experiment, the cells should be diluted, isolated on solid media and assayed for growth phenotypes matching that of the culture flask. Best performers from those selected are then prepped for genomic DNA and sent for whole genome sequencing. Sequencing with reveal mutations occurring around the genome capable of providing improved phenotypes, but will also contain silent mutations (those which provide no benefit but do not detract from desired phenotype). In cultures evolved in the presence of NTG or other chemical mutagen, there will be significantly more silent, background mutations. If satisfied with the best performing strain in its current state, the user can proceed to application with that strain. Otherwise the contributing mutations can be deconvoluted from the evolved strain by reintroducing the mutations to the parent strain by genome engineering techniques. See Lee, D.-H., Feist, A. M., Barrett, C. L. & Palsson, B. Ø. Cumulative Number of Cell Divisions as a Meaningful Timescale for Adaptive Laboratory Evolution of *Escherichia coli*. PLoS ONE 6, e26172 (2011).

Similar methods can be used to generate *E. Coli* Nissle mutants that consume or import tryptophan.

Inducible Regulatory Regions

FNR-Dependent Regulation

In some embodiments, the genetically engineered bacteria comprise a promoter that is directly or indirectly induced by exogenous environmental conditions. In certain embodiments, the bacterial cell comprises one or more gene sequence(s) for producing the payload(s). As used herein the term "payload" refers to one or more e.g. anti-inflammation and/or gut barrier function enhancer molecule(s), including but not limited to, butyrate, propionate, acetate, IL10, IL-2, IL-22, IL-27, IL-20, IL-24, IL-19, SOD, GLP2, and/or tryptophan and/or its metabolites. In some embodiments the payload is expressed under the control of the fumarate and nitrate reductase regulator (FNR) promoter. In certain embodiments, the bacterial cell comprises one or more gene sequence(s) for producing the payload(s), e.g., an anti-inflammation and/or gut barrier function enhancer molecule, which is expressed under the control of the fumarate and nitrate reductase regulator (FNR) promoter. In certain embodiments, the bacterial cell comprises one or more gene sequence(s) for producing the payload(s) which is operably linked to an oxygen level-dependent promoter such that the therapeutic molecule is expressed in low-oxygen, microaerobic, or anaerobic conditions. For example, in low-oxygen conditions, the oxygen level-dependent promoter is activated by a corresponding oxygen level-sensing transcriptional regulator, thereby driving production of the therapeutic molecule(s.). In certain embodiments, the genetically engineered bacteria comprise one or more gene sequence(s) for producing an anti-inflammation and/or gut barrier function enhancer molecule expressed under the control of a fumarate and nitrate reductase regulator (FNR)-responsive promoter, an anaerobic regulation of arginine deiminiase and nitrate reduction (ANR)-responsive promoter, or a dissimilatory nitrate respiration regulator (DNR)-responsive promoter, which are capable of being regulated by the transcription factors FNR, ANR, or DNR, respectively. In *E. coli*, FNR is a major transcriptional activator that controls the switch from aerobic to anaerobic metabolism (Unden et al., 1997). In the anaerobic state, FNR dimerizes into an active DNA binding protein that activates hundreds of genes responsible for adapting to anaerobic growth. In the aerobic state, FNR is prevented from dimerizing by oxygen and is inactive.

FNR responsive promoters include, but are not limited to, the FNR responsive promoters listed in the chart, below. Underlined sequences are predicted ribosome binding sites, and bolded sequences are restriction sites used for cloning.

TABLE 25

FNR Promoter Sequences

| FNR Responsive Promoter | Sequence |
| --- | --- |
| SEQ ID NO: 141 | GTCAGCATAACACCCTGACCTCTCATTAATTGTTCATGCCGGGCGGCACTATCGTCGTCCGGCCT TTTCCTCTCTTACTCTGCTACGTACATCTATTTCTATAAATCCGTTCAATTTGTCTGTTTTTTGCACA AACATGAAATATCAGACAATTCCGTGACTTAAGAAAATTTATACAAATCAGCAATATACCCCTTA AGGAGTATATAAAGGTGAATTTGATTTACATCAATAAGCGGGGTTGCTGAATCGTTAAGGTAGG CGGTAATAG<u>AAAAGAAAT</u>CGAGGCAAAA |

TABLE 25-continued

FNR Promoter Sequences

| FNR Responsive Promoter | Sequence |
|---|---|
| SEQ ID NO: 142 | ATTTCCTCTCATCCCATCCGGGGTGAGAGTCTTTTCCCCCGACTTATGGCTCATGCATGCATCAAA AAAGATGTGAGCTTGATCAAAAACAAAAAATATTTCACTCGACAGGAGTATTTATATTGCGCCCG TTACGTGGGCTTCGACTGTAAAT<u>AGAAAGGAGAAAACACCT</u> |
| SEQ ID NO: 143 | GTCAGCATAACACCCTGACCTCTCATTAATTGTTCATGCCGGGCGGCACTATCGTCGTCCGGCCT TTTCCTCTCTTACTCTGCTACGTACATCTATTTCTATAAATCCGTTCAATTTGTCTGTTTTTTGCACA AACATGAAATATCAGACAATTCCGTGACTTAAGAAAATTTATACAAATCAGCAATATACCCCTTA AGGAGTATATAAAGGTGAATTTGATTTACATCAATAAGCGGGGTTGCTGAATCGTTAAGGATCC <u>CTCTAGAAATAATTTTGTTTAACTTTAAGAAGGAGATATACAT</u> |
| SEQ ID NO: 144 | CATTTCCTCTCATCCCATCCGGGGTGAGAGTCTTTTCCCCCGACTTATGGCTCATGCATGCATCAA AAAAGATGTGAGCTTGATCAAAAACAAAAAATATTTCACTCGACAGGAGTATTTATATTGCGCCC GGATCC<u>CTCTAGAAATAATTTTGTTTAACTTTAAGAAGGAGATATACAT</u> |
| SEQ ID NO: 145 | AGTTGTTCTTATTGGTGGTGTTGCTTTATGGTTGCATCGTAGTAAATGGTTGTAACAAAAGCAAT TTTTCCGGCTGTCTGTATACAAAAACGCCGTAAAGTTTGAGCGAAGTCAATAAACTCTCTACCCA TTCAGGGCAATATCTCTCTTGGATCC<u>CTCTAGAAATAATTTTGTTTAACTTTAAGAAGGAGATATA CAT</u> |

In one embodiment, the FNR responsive promoter comprises SEQ ID NO: 141. In another embodiment, the FNR responsive promoter comprises SEQ ID NO: 142. In another embodiment, the FNR responsive promoter comprises SEQ ID NO: 143. In another embodiment, the FNR responsive promoter comprises SEQ ID NO: 144. In yet another embodiment, the FNR responsive promoter comprises SEQ ID NO: 145. Additional FNR responsive promoters are shown below.

TABLE 26

FNR Promoter sequences

| FNR-responsive regulatory region | 12345678901234567890123456789012345678901234567890 |
|---|---|
| SEQ ID NO: 146 | ATCCCCATCACTCTTGATGGAGATCAATTCCCCAAGCTGCTAGAGCGTTA CCTTGCCCTTAAACATTAGCAATGTCGATTTATCAGAGGGCCGACAGGCT CCCACAGGAGAAAACCG |
| SEQ ID NO: 147 | CTCTTGATCGTTATCAATTCCCACGCTGTTTCAGAGCGTTACCTTGCCCT TAAACATTAGCAATGTCGATTTATCAGAGGGCCGACAGGCTCCCACAGGA GAAAACCG |
| nirB1 SEQ ID NO: 148 | GTCAGCATAACACCCTGACCTCTCATTAATTGTTCATGCCGGGCGGCACT ATCGTCGTCCGGCCTTTTCCTCTCTTACTCTGCTACGTACATCTATTTCT ATAAATCCGTTCAATTTGTCTGTTTTTTGCACAAACATGAAATATCAGAC AATTCCGTGACTTAAGAAAATTTATACAAATCAGCAATATACCCCTTAAG GAGTATATAAAGGTGAATTTGATTTACATCAATAAGCGGGGTTGCTGAAT CGTTAAGGTAGGCGGTAATAG<u>AAAAGAAATCGAGGCAAAA</u> |
| nirB2 SEQ ID NO: 149 | CGGCCCGATCGTTGAACATAGCGGTCCGCAGGCGGCACTGCTTACAGCAA ACGGTCTGTACGCTGTCGTCTTTGTGATGTGCTTCCTGTTAGGTTTCGTC AGCCGTCACCGTCAGCATAACACCCTGACCTCTCATTAATTGCTCATGCC GGACGGCACTATCGTCGTCCGGCCTTTTCCTCTCTTCCCCCGCTACGTGC ATCTATTTCTATAAACCCGCTCATTTTGTCTATTTTTTGCACAAACATGA AATATCAGACAATTCCGTGACTTAAGAAAATTTATACAAATCAGCAATAT ACCCATTAAGGAGTATATAAAGGTGAATTTGATTTACATCAATAAGCGGG GTTGCTGAATCGTTAAGGTAGGCGGTAATAGAAAAGAAATCGAGGCAAAA atgtttgtttaactttaagaaggagatatacat |
| nirB3 SEQ ID NO: 150 | GTCAGCATAACACCCTGACCTCTCATTAATTGCTCATGCCGGACGGCACT ATCGTCGTCCGGCCTTTTCCTCTCTTCCCCCGCTACGTGCATCTATTTCT ATAAACCCGCTCATTTTGTCTATTTTTTGCACAAACATGAAATATCAGAC AATTCCGTGACTTAAGAAAATTTATACAAATCAGCAATATACCCATTAAG GAGTATATAAAGGTGAATTTGATTTACATCAATAAGCGGGGTTGCTGAAT CGTTAAGGTAGGCGGTAATAGAAAAGAAATCGAGGCAAAA |
| ydfZ SEQ ID NO: 151 | ATTTCCTCTCATCCCATCCGGGGTGAGAGTCTTTTCCCCCGACTTATGGC TCATGCATGCATCAAAAAAGATGTGAGCTTGATCAAAAACAAAAAATATT TCACTCGACAGGAGTATTTATATTGCGCCCGTTACGTGGGCTTCGACTGT AAATC<u>AGAAAGGAGAAAACACCT</u> |

TABLE 26-continued

FNR Promoter sequences

| FNR-responsive regulatory region | 123456789012345678901234567890123456789012345678 90 |
|---|---|
| nirB + RBS SEQ ID NO: 152 | GTCAGCATAACACCCTGACCTCTCATTAATTGTTCATGCCGGGCGGCACT<br>ATCGTCGTCCGGCCTTTTCCTCTCTTACTCTGCTACGTACATCTATTTCT<br>ATAAATCCGTTCAATTTGTCTGTTTTTTGCACAAACATGAAATATCAGAC<br>AATTCCGTGACTTAAGAAAATTTATACAAATCAGCAATATACCCCTTAAG<br>GAGTATATAAAGGTGAATTTGATTTACATCAATAAGCGGGGTTGCTGAAT<br>CGTTAAGGATCCCTCTAGAAATAATTTTGTTTAACTTTAAGAAGGAGATA<br>TACAT |
| ydfZ + RBS SEQ ID NO: 153 | CATTTCCTCTCATCCCATCCGGGGTGAGAGTCTTTTCCCCCGACTTATGG<br>CTCATGCATGCATCAAAAAAGATGTGAGCTTGATCAAAAACAAAAAATAT<br>TTCACTCGACAGGAGTATTTATATTGCGCCCGGATCCCTCTAGAAATAAT<br>TTTGTTTAACTTTAAGAAGGAGATATACAT |
| fnrS1 SEQ ID NO: 154 | AGTTGTTCTTATTGGTGGTGTTGCTTTATGGTTGCATCGTAGTAAATGGT<br>TGTAACAAAAGCAATTTTTCCGGCTGTCTGTATACAAAAACGCCGTAAAG<br>TTTGAGCGAAGTCAATAAACTCTCTACCCATTCAGGGCAATATCTCTCTT<br>GGATCCCTCTAGAAATAATTTTGTTTAACTTTAAGAAGGAGATATACAT |
| fnrS2 SEQ ID NO: 155 | AGTTGTTCTTATTGGTGGTGTTGCTTTATGGTTGCATCGTAGTAAATGGT<br>TGTAACAAAAGCAATTTTTCCGGCTGTCTGTATACAAAAACGCCGCAAAG<br>TTTGAGCGAAGTCAATAAACTCTCTACCCATTCAGGGCAATATCTCTCTT<br>GGATCCAAAGTGAACTCTAGAAATAATTTTGTTTAACTTTAAGAAGGAGA<br>TATACAT |
| nirB + crp SEQ ID NO: 156 | TCGTCTTTGTGATGTGCTTCCTGTTAGGTTTCGTCAGCCGTCACCGTCAG<br>CATAACACCCTGACCTCTCATTAATTGCTCATGCCGGACGGCACTATCGT<br>CGTCCGGCCTTTTCCTCTCTTCCCCCGCTACGTGCATCTATTTCTATAAA<br>CCCGCTCATTTTGTCTATTTTTTGCACAAACATGAAATATCAGACAATTC<br>CGTGACTTAAGAAAATTTATACAAATCAGCAATATACCCATTAAGGAGTA<br>TATAAAGGTGAATTTGATTTACATCAATAAGCGGGGTTGCTGAATCGTTA<br>AGGTAGaaatgtgatctagttcacatttGCGGTAATAGAAAAGAAATCGA<br>GGCAAAAatgtttgtttaactttaagaaggagatatacat |
| fnrS + crp SEQ ID NO: 157 | AGTTGTTCTTATTGGTGGTGTTGCTTTATGGTTGCATCGTAGTAAATGGT<br>TGTAACAAAAGCAATTTTTCCGGCTGTCTGTATACAAAAACGCCGCAAAG<br>TTTGAGCGAAGTCAATAAACTCTCTACCCATTCAGGGCAATATCTCTCaa<br>atgtgatctagttcacattttttgtttaactttaagaaggagatatacat |

In some embodiments, gene expression is further optimized by methods known in the art, e.g., by optimizing ribosomal binding sites and/or increasing mRNA stability. FNR promoter sequences are known in the art, and any suitable FNR promoter sequence(s) may be used in the genetically engineered bacteria of the invention. Any suitable FNR promoter(s) may be combined with any suitable gene or gene cassette for producing an anti-inflammation and/or gut barrier function enhancer molecule. Non-limiting FNR promoter sequences are provided in Table 26. In some embodiments, the genetically engineered bacteria of the invention comprise one or more of: SEQ ID NO: 146, SEQ ID NO: 147, nirB1 promoter (SEQ ID NO: 148), nirB2 promoter (SEQ ID NO: 149), nirB3 promoter (SEQ ID NO: 150), ydfZ promoter (SEQ ID NO: 151), nirB promoter fused to a strong ribosome binding site (SEQ ID NO: 152), ydfZ promoter fused to a strong ribosome binding site (SEQ ID NO: 153), fnrS, an anaerobically induced small RNA gene (fnrS1 promoter SEQ ID NO: 154 or fnrS2 promoter SEQ ID NO: 155), nirB promoter fused to a crp binding site (SEQ ID NO: 156), and fnrS fused to a crp binding site (SEQ ID NO: 157). In some embodiments, genetically engineered bacteria comprise a nucleic acid sequence that is at least about 80%, at least about 85%, at least about 90%, at least about 95%, or at least about 99% homologous to the DNA sequence of SEQ ID NO: 146, 147, 148, 149, 150, 151, 152, 153, 154, 155, 156, or 157, or a functional fragment thereof.

In some embodiments, multiple distinct FNR nucleic acid sequences are inserted in the genetically engineered bacteria. In alternate embodiments, the genetically engineered bacteria comprise one or more gene sequence(s) for producing the payload(s) which are expressed under the control of an alternate oxygen level-dependent promoter, e.g., DNR (Trunk et al., 2010) or ANR (Ray et al., 1997). In these embodiments, expression of the payload is particularly activated in a low-oxygen or anaerobic environment, such as in the gut. In one embodiment, the mammalian gut is a human mammalian gut.

In other embodiments, the one or more gene sequence(s) for producing an anti-inflammation and/or gut barrier function enhancer molecule are expressed under the control of an oxygen level-dependent promoter fused to a binding site for a transcriptional activator, e.g., CRP. CRP (cyclic AMP receptor protein or catabolite activator protein or CAP) plays a major regulatory role in bacteria by repressing genes responsible for the uptake, metabolism, and assimilation of less favorable carbon sources when rapidly metabolizable carbohydrates, such as glucose, are present (Wu et al., 2015). This preference for glucose has been termed glucose repression, as well as carbon catabolite repression (Deutscher, 2008; Görke and Stülke, 2008). In some embodiments, the gene or gene cassette for producing an anti-inflammation and/or gut barrier function enhancer molecule is controlled by an oxygen level-dependent promoter fused to a CRP binding site. In some embodiments, the one or more gene sequence(s) for producing an anti-inflammation and/or gut barrier function enhancer molecule are controlled by a FNR promoter fused to a CRP binding site. In these embodiments, cyclic AMP binds to CRP when no glucose is present in the environment. This binding causes a conformational change in CRP, and allows CRP to bind tightly to its binding site. CRP binding then activates transcription of the gene or gene cassette by recruiting RNA polymerase to the FNR promoter via direct protein-protein interactions. In the presence of glucose, cyclic AMP does not bind to CRP and transcription of the gene or gene cassette for producing an anti-inflammation and/or gut barrier function enhancer molecule is repressed. In some embodiments, an oxygen level-dependent promoter (e.g., an FNR promoter) fused to a binding site for a transcriptional activator is used to ensure that the gene or gene cassette for producing an anti-inflammation and/or gut barrier function enhancer molecule is not expressed under anaerobic conditions when sufficient amounts of glucose are present, e.g., by adding glucose to growth media in vitro.

In some embodiments, the genetically engineered bacteria comprise an oxygen level-dependent promoter from a different species, strain, or substrain of bacteria. In some embodiments, the genetically engineered bacteria comprise an oxygen level-sensing transcription factor, e.g., FNR, ANR or DNR, from a different species, strain, or substrain of bacteria. In some embodiments, the genetically engineered bacteria comprise an oxygen level-sensing transcription factor and corresponding promoter from a different species, strain, or substrain of bacteria. The heterologous oxygen-level dependent transcriptional regulator and/or promoter increases the transcription of genes operably linked to said promoter, e.g., one or more gene sequence(s) for producing the payload(s) in a low-oxygen or anaerobic environment, as compared to the native gene(s) and promoter in the bacteria under the same conditions. In certain embodiments, the non-native oxygen-level dependent transcriptional regulator is an FNR protein from N gonorrhoeae (see, e.g., Isabella et al., 2011). In some embodiments, the corresponding wild-type transcriptional regulator is left intact and retains wild-type activity. In alternate embodiments, the corresponding wild-type transcriptional regulator is deleted or mutated to reduce or eliminate wild-type activity.

In some embodiments, the genetically engineered bacteria comprise a wild-type oxygen-level dependent transcriptional regulator, e.g., FNR, ANR, or DNR, and corresponding promoter that is mutated relative to the wild-type promoter from bacteria of the same subtype. The mutated promoter enhances binding to the wild-type transcriptional regulator and increases the transcription of genes operably linked to said promoter, as compared to the wild-type promoter under the same conditions. In some embodiments, the genetically engineered bacteria comprise a wild-type oxygen-level dependent promoter, e.g., FNR, ANR, or DNR promoter, and corresponding transcriptional regulator that is mutated relative to the wild-type transcriptional regulator from bacteria of the same subtype. The mutated transcriptional regulator enhances binding to the wild-type promoter and increases the transcription of genes operably linked to said promoter in a low-oxygen or anaerobic environment, as compared to the wild-type transcriptional regulator under the same conditions. In certain embodiments, the mutant oxygen-level dependent transcriptional regulator is an FNR protein comprising amino acid substitutions that enhance dimerization and FNR activity (see, e.g., Moore et al., 2006).

In some embodiments, both the oxygen level-sensing transcriptional regulator and corresponding promoter are mutated relative to the wild-type sequences from bacteria of the same subtype in order to increase expression of the anti-inflammation and/or gut barrier enhancer molecule in low-oxygen conditions.

In some embodiments, the bacterial cells disclosed herein comprise multiple copies of the endogenous gene encoding the oxygen level-sensing transcriptional regulator, e.g., the FNR gene. In some embodiments, the gene encoding the oxygen level-sensing transcriptional regulator is present on a plasmid. In some embodiments, the gene encoding the oxygen level-sensing transcriptional regulator and the one or more gene sequence(s) for producing the payload(s) are present on different plasmids. In some embodiments, the gene encoding the oxygen level-sensing transcriptional regulator and one or more gene sequence(s) for producing the payload(s) are present on different plasmids. In some embodiments, the gene encoding the oxygen level-sensing transcriptional regulator and the one or more gene sequence(s) for producing the payload(s) are present on the same plasmid.

In some embodiments, the gene encoding the oxygen level-sensing transcriptional regulator is present on a chromosome. In some embodiments, the gene encoding the oxygen level-sensing transcriptional regulator and the one or more gene sequence(s) for producing the payload(s) are present on different chromosomes. In some embodiments, the gene encoding the oxygen level-sensing transcriptional regulator and the one or more gene sequence(s) for producing the payload(s) are present on the same chromosome.

In some instances, it may be advantageous to express the oxygen level-sensing transcriptional regulator under the control of an inducible promoter in order to enhance expression stability. In some embodiments, expression of the transcriptional regulator is controlled by a different promoter than the promoter that controls expression of the one or more gene sequence(s) for producing the payload(s). In some embodiments, expression of the transcriptional regulator is controlled by the same promoter that controls expression of the one or more gene sequence(s) for producing the payload(s). In some embodiments, the transcriptional regulator and the payload(s) are divergently transcribed from a promoter region.

In some embodiments, the gene or gene cassette for producing the anti-inflammation and/or gut barrier function enhancer molecule is present on a plasmid and operably linked to a promoter that is induced by low-oxygen conditions. In some embodiments, the gene or gene cassette for producing the anti-inflammation and/or gut barrier function enhancer molecule is present in the chromosome and operably linked to a promoter that is induced by low-oxygen conditions. In some embodiments, the gene or gene cassette for producing the anti-inflammation and/or gut barrier function enhancer molecule is present on a chromosome and operably linked to a promoter that is induced by exposure to tetracycline. In some embodiments, the gene or gene cassette for producing the anti-inflammation and/or gut barrier function enhancer molecule is present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria comprise a stably maintained plasmid or chromosome carrying the gene(s) or gene cassette(s) capable of producing an anti-inflammation and/or gut barrier function enhancer molecule, such that the gene(s) or gene cassette(s) can be expressed in the host cell, and the host cell is capable of survival and/or growth in vitro, e.g., in medium, and/or in vivo, e.g., in the gut. In some embodiments, a bacterium may comprise multiple copies of the gene or gene cassette for producing the anti-inflammation and/or gut barrier function enhance molecule. In some embodiments, the gene or gene cassette is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, the gene or gene cassette is expressed on a high-copy plasmid. In some embodiments, the high-copy plasmid may be useful for increasing gene or gene cassette expression. In some embodiments, gene or gene cassette is expressed on a chromosome.

In some embodiments, the genetically engineered bacteria may comprise multiple copies of the gene(s) or gene cassette(s) capable of producing an anti-inflammation and/or gut barrier function enhancer molecule. In some embodiments, the gene(s) or gene cassette(s) capable of producing an anti-inflammation and/or gut barrier function enhancer molecule is present on a plasmid and operably linked to an oxygen level-dependent promoter. In some embodiments, the gene(s) or gene cassette(s) capable of producing an anti-inflammation and/or gut barrier function enhancer molecule is present in a chromosome and operably linked to an oxygen level-dependent promoter.

In some embodiments, the genetically engineered bacteria of the invention produce at least one anti-inflammation and/or gut barrier enhancer molecule in low-oxygen conditions to reduce local gut inflammation by at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold as compared to unmodified bacteria of the same subtype under the same conditions. Inflammation may be measured by methods known in the art, e.g., counting disease lesions using endoscopy; detecting T regulatory cell differentiation in peripheral blood, e.g., by fluorescence activated sorting; measuring T regulatory cell levels; measuring cytokine levels; measuring areas of mucosal damage; assaying inflammatory biomarkers, e.g., by qPCR; PCR arrays; transcription factor phosphorylation assays; immunoassays; and/or cytokine assay kits (Mesoscale, Cayman Chemical, Qiagen).

In some embodiments, the genetically engineered bacteria produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of one more payload(s), e.g., one or more anti-inflammation and/or gut barrier enhancer molecule(s) in low-oxygen conditions than unmodified bacteria of the same subtype under the same conditions. Certain unmodified bacteria will not have detectable levels of the anti-inflammation and/or gut barrier enhancer molecule. In embodiments using genetically modified forms of these bacteria, the anti-inflammation and/or gut barrier enhancer molecule will be detectable in low-oxygen conditions.

In certain embodiments, the anti-inflammation and/or gut barrier enhancer molecule is butyrate. Methods of measuring butyrate levels, e.g., by mass spectrometry, gas chromatography, high-performance liquid chromatography (HPLC), are known in the art (see, e.g., Aboulnaga et al., 2013). In some embodiments, butyrate is measured as butyrate level/bacteria optical density (OD). In some embodiments, measuring the activity and/or expression of one or more gene products in the butyrogenic gene cassette serves as a proxy measurement for butyrate production. In some embodiments, the bacterial cells of the invention are harvested and lysed to measure butyrate production. In alternate embodiments, butyrate production is measured in the bacterial cell medium. In some embodiments, the genetically engineered bacteria produce at least about 1 nM/OD, at least about 10 nM/OD, at least about 100 nM/OD, at least about 500 nM/OD, at least about 1 µM/OD, at least about 10 µM/OD, at least about 100 µM/OD, at least about 500 µM/OD, at least about 1 mM/OD, at least about 2 mM/OD, at least about 3 mM/OD, at least about 5 mM/OD, at least about 10 mM/OD, at least about 20 mM/OD, at least about 30 mM/OD, or at least about 50 mM/OD of butyrate in low-oxygen conditions.

In certain embodiments, the anti-inflammation and/or gut barrier enhancer molecule is propionate. Methods of measuring propionate levels, e.g., by mass spectrometry, gas chromatography, high-performance liquid chromatography (HPLC), are known in the art (see, e.g., Hillman, 1978; Lukovac et al., 2014). In some embodiments, measuring the activity and/or expression of one or more gene products in the propionate gene cassette serves as a proxy measurement for propionate production. In some embodiments, the bacterial cells of the invention are harvested and lysed to measure propionate production. In alternate embodiments, propionate production is measured in the bacterial cell medium. In some embodiments, the genetically engineered bacteria produce at least about 1 µM, at least about 10 µM, at least about 100 µM, at least about 500 µM, at least about 1 mM, at least about 2 mM, at least about 3 mM, at least about 5 mM, at least about 10 mM, at least about 15 mM, at least about 20 mM, at least about 30 mM, at least about 40 mM, or at least about 50 mM of propionate in low-oxygen conditions.

RNS-Dependent Regulation

In some embodiments, the genetically engineered bacteria comprise one or more gene sequence(s) for producing one or more payload(s) which are expressed under the control of an inducible promoter. In some embodiments, the genetically engineered bacterium that expresses one or more gene sequence(s) for producing the payload(s) are under the control of a promoter that is activated by inflammatory conditions. In one embodiment, the one or more gene sequence(s) for producing the payload(s) are expressed under the control of an inflammatory-dependent promoter that is activated in inflammatory environments, e.g., a reactive nitrogen species or RNS promoter.

As used herein, "reactive nitrogen species" and "RNS" are used interchangeably to refer to highly active molecules, ions, and/or radicals derived from molecular nitrogen. RNS can cause deleterious cellular effects such as nitrosative stress. RNS includes, but is not limited to, nitric oxide (NO•), peroxynitrite or peroxynitrite anion (ONOO—), nitrogen dioxide (•NO2), dinitrogen trioxide (N2O3), peroxynitrous acid (ONOOH), and nitroperoxycarbonate (ONOOCO2-) (unpaired electrons denoted by •). Bacteria have evolved transcription factors that are capable of sensing RNS levels. Different RNS signaling pathways are triggered by different RNS levels and occur with different kinetics.

As used herein, "RNS-inducible regulatory region" refers to a nucleic acid sequence to which one or more RNS-sensing transcription factors is capable of binding, wherein the binding and/or activation of the corresponding transcription factor activates downstream gene expression; in the presence of RNS, the transcription factor binds to and/or activates the regulatory region. In some embodiments, the RNS-inducible regulatory region comprises a promoter sequence. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; in the presence of RNS, the transcription factor undergoes a conformational change, thereby activating downstream gene expression. The RNS-inducible regulatory region may be operatively linked to one or more gene sequence(s) for producing the payload(s). For example, in the presence of RNS, a transcription factor senses RNS and activates a corresponding RNS-inducible regulatory region, thereby driving expression of an operatively linked gene sequence. Thus, RNS induces expression of the gene or gene sequences.

As used herein, "RNS-derepressible regulatory region" refers to a nucleic acid sequence to which one or more RNS-sensing transcription factors is capable of binding, wherein the binding of the corresponding transcription factor represses downstream gene expression; in the presence of RNS, the transcription factor does not bind to and does not repress the regulatory region. In some embodiments, the RNS-derepressible regulatory region comprises a promoter sequence. The RNS-derepressible regulatory region may be operatively linked to one or more gene sequence(s) for producing the payload(s). For example, in the presence of RNS, a transcription factor senses RNS and no longer binds to and/or represses the regulatory region, thereby derepressing an operatively linked gene sequence or gene cassette. Thus, RNS derepresses expression of the gene or genes.

As used herein, "RNS-repressible regulatory region" refers to a nucleic acid sequence to which one or more RNS-sensing transcription factors is capable of binding, wherein the binding of the corresponding transcription factor represses downstream gene expression; in the presence of RNS, the transcription factor binds to and represses the regulatory region. In some embodiments, the RNS-repressible regulatory region comprises a promoter sequence. In some embodiments, the transcription factor that senses RNS is capable of binding to a regulatory region that overlaps with part of the promoter sequence. In alternate embodiments, the transcription factor that senses RNS is capable of binding to a regulatory region that is upstream or downstream of the promoter sequence. The RNS-repressible regulatory region may be operatively linked to a gene sequence or gene cassette. For example, in the presence of RNS, a transcription factor senses RNS and binds to a corresponding RNS-repressible regulatory region, thereby blocking expression of an operatively linked gene sequence or gene sequences. Thus, RNS represses expression of the gene or gene sequences.

As used herein, a "RNS-responsive regulatory region" refers to a RNS-inducible regulatory region, a RNS-repressible regulatory region, and/or a RNS-derepressible regulatory region. In some embodiments, the RNS-responsive regulatory region comprises a promoter sequence. Each regulatory region is capable of binding at least one corresponding RNS-sensing transcription factor. Examples of transcription factors that sense RNS and their corresponding RNS-responsive genes, promoters, and/or regulatory regions include, but are not limited to, those shown in Table 27.

TABLE 27

Examples of RNS-sensing transcription factors and RNS-responsive genes

| RNS-sensing transcription factor: | Primarily capable of sensing: | Examples of responsive genes, promoters, and/or regulatory regions: |
|---|---|---|
| NsrR | NO | norB, aniA, nsrR, hmpA, ytfE, ygbA, hcp, her, nrfA, aox |
| NorR | NO | norVW, norR |
| DNR | NO | norCB, nir, nor, nos |

In some embodiments, the genetically engineered bacteria of the invention comprise a tunable regulatory region that is directly or indirectly controlled by a transcription factor that is capable of sensing at least one reactive nitrogen species. The tunable regulatory region is operatively linked to one or more gene sequence(s) for producing the payload(s), thus controlling expression of the payload(s) relative to RNS levels. For example, the tunable regulatory region is a RNS-inducible regulatory region, and the payload is any of the payloads described herein; when RNS is present, e.g., in an inflamed tissue, a RNS-sensing transcription factor binds to and/or activates the regulatory region and drives expression of the payload(s). Subsequently, when inflammation is ameliorated, RNS levels are reduced, and production of the payload(s) is decreased or eliminated.

In some embodiments, the tunable regulatory region is a RNS-inducible regulatory region; in the presence of RNS, a transcription factor senses RNS and activates the RNS-inducible regulatory region, thereby driving expression of an operatively linked gene or genes. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; when the transcription factor senses RNS, it undergoes a conformational change, thereby inducing downstream gene expression.

In some embodiments, the tunable regulatory region is a RNS-inducible regulatory region, and the transcription factor that senses RNS is NorR. NorR "is an NO-responsive transcriptional activator that regulates expression of the norVW genes encoding flavorubredoxin and an associated flavoprotein, which reduce NO to nitrous oxide" (Spiro 2006). The genetically engineered bacteria of the invention may comprise any suitable RNS-responsive regulatory region from a gene that is activated by NorR. Genes that are capable of being activated by NorR are known in the art (see, e.g., Spiro 2006; Vine et al., 2011; Karlinsey et al., 2012; Table 1). In certain embodiments, the genetically engineered bacteria of the invention comprise a RNS-inducible regulatory region from norVW that is operatively linked to one or more gene sequence(s) for producing the payload(s). In the presence of RNS, a NorR transcription factor senses RNS and activates to the norVW regulatory region, thereby driving expression of the operatively linked gene, gene(s), or gene cassettes and producing the payload(s).

In some embodiments, the tunable regulatory region is a RNS-inducible regulatory region, and the transcription factor that senses RNS is DNR. DNR (dissimilatory nitrate respiration regulator) "promotes the expression of the nir, the nor and the nos genes" in the presence of nitric oxide (Castiglione et al., 2009). The genetically engineered bacteria of the invention may comprise any suitable RNS-responsive regulatory region from a gene that is activated by DNR. Genes that are capable of being activated by DNR are known in the art (see, e.g., Castiglione et al., 2009; Giardina et al., 2008; Table 1). In certain embodiments, the genetically engineered bacteria of the invention comprise a RNS-inducible regulatory region from norCB that is operatively linked to a gene or gene cassette, e.g., a butyrogenic gene cassette. In the presence of RNS, a DNR transcription factor senses RNS and activates to the norCB regulatory region, thereby driving expression of the operatively linked gene or genes and producing one or more payload(s). In some embodiments, the DNR is *Pseudomonas aeruginosa* DNR.

In some embodiments, the tunable regulatory region is a RNS-derepressible regulatory region, and binding of a corresponding transcription factor represses downstream gene expression; in the presence of RNS, the transcription factor no longer binds to the regulatory region, thereby derepressing the operatively linked gene or gene cassette.

In some embodiments, the tunable regulatory region is a RNS-derepressible regulatory region, and the transcription factor that senses RNS is NsrR. NsrR is "an Rrf2-type transcriptional repressor [that] can sense NO and control the expression of genes responsible for NO metabolism" (Isabella et al., 2009). The genetically engineered bacteria of the invention may comprise any suitable RNS-responsive regulatory region from a gene that is repressed by NsrR. In some embodiments, the NsrR is *Neisseria gonorrhoeae* NsrR. Genes that are capable of being repressed by NsrR are known in the art (see, e.g., Isabella et al., 2009; Dunn et al., 2010; Table 1). In certain embodiments, the genetically engineered bacteria of the invention comprise a RNS-derepressible regulatory region from norB that is operatively linked to a gene or genes. In the presence of RNS, an NsrR transcription factor senses RNS and no longer binds to the norB regulatory region, thereby derepressing the operatively linked gene, gene(s), or gene cassettes for producing the payload(s) and producing the payload(s).

In some embodiments, it is advantageous for the genetically engineered bacteria to express a RNS-sensing transcription factor that does not regulate the expression of a significant number of native genes in the bacteria. In some embodiments, the genetically engineered bacterium of the invention expresses a RNS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the RNS-sensing transcription factor is NsrR, e.g., from is *Neisseria gonorrhoeae*, wherein the *Escherichia coli* does not comprise binding sites for said NsrR. In some embodiments, the heterologous transcription factor minimizes or eliminates off-target effects on endogenous regulatory regions and genes in the genetically engineered bacteria.

In some embodiments, the tunable regulatory region is a RNS-repressible regulatory region, and binding of a corresponding transcription factor represses downstream gene expression; in the presence of RNS, the transcription factor senses RNS and binds to the RNS-repressible regulatory region, thereby repressing expression of the operatively linked gene or gene cassette. In some embodiments, the RNS-sensing transcription factor is capable of binding to a regulatory region that overlaps with part of the promoter sequence. In alternate embodiments, the RNS-sensing transcription factor is capable of binding to a regulatory region that is upstream or downstream of the promoter sequence.

In these embodiments, the genetically engineered bacteria may comprise a two repressor activation regulatory circuit, which is used to express one or more payload(s). The two repressor activation regulatory circuit comprises a first RNS-sensing repressor and a second repressor, which is operatively linked to one or more gene sequence(s) for producing the payload(s). In one aspect of these embodiments, the RNS-sensing repressor inhibits transcription of the second repressor, which inhibits the transcription of the gene or gene cassette. Examples of second repressors useful in these embodiments include, but are not limited to, TetR, Cl, and LexA. In the absence of binding by the first repressor (which occurs in the absence of RNS), the second repressor is transcribed, which represses expression of the gene or genes. In the presence of binding by the first repressor (which occurs in the presence of RNS), expression of the second repressor is repressed, and the one or more gene sequence(s) for producing the payload(s) are expressed.

A RNS-responsive transcription factor may induce, derepress, or repress gene expression depending upon the regulatory region sequence used in the genetically engineered bacteria. One or more types of RNS-sensing transcription factors and corresponding regulatory region sequences may be present in genetically engineered bacteria. In some embodiments, the genetically engineered bacteria comprise one type of RNS-sensing transcription factor, e.g., NsrR, and one corresponding regulatory region sequence, e.g., from norB. In some embodiments, the genetically engineered bacteria comprise one type of RNS-sensing transcription factor, e.g., NsrR, and two or more different corresponding regulatory region sequences, e.g., from norB and aniA. In some embodiments, the genetically engineered bacteria comprise two or more types of RNS-sensing transcription factors, e.g., NsrR and NorR, and two or more corresponding regulatory region sequences, e.g., from norB and norR, respectively. One RNS-responsive regulatory region may be capable of binding more than one transcription factor. In some embodiments, the genetically engineered bacteria comprise two or more types of RNS-sensing transcription factors and one corresponding regulatory region sequence. Nucleic acid sequences of several RNS-regulated regulatory regions are known in the art (see, e.g., Spiro 2006; Isabella et al., 2009; Dunn et al., 2010; Vine et al., 2011; Karlinsey et al., 2012).

In some embodiments, the genetically engineered bacteria of the invention comprise a gene encoding a RNS-sensing transcription factor, e.g., the nsrR gene, that is controlled by its native promoter, an inducible promoter, a promoter that is stronger than the native promoter, e.g., the GlnRS promoter or the P(Bla) promoter, or a constitutive promoter. In some instances, it may be advantageous to express the RNS-sensing transcription factor under the control of an inducible promoter in order to enhance expression stability. In some embodiments, expression of the RNS-sensing transcription factor is controlled by a different promoter than the promoter that controls expression of the therapeutic molecule. In some embodiments, expression of the RNS-sensing transcription factor is controlled by the same promoter that controls expression of the therapeutic molecule. In some embodiments, the RNS-sensing transcription factor and therapeutic molecule are divergently transcribed from a promoter region.

In some embodiments, the genetically engineered bacteria of the invention comprise a gene for a RNS-sensing transcription factor from a different species, strain, or substrain of bacteria. In some embodiments, the genetically engineered bacteria comprise a RNS-responsive regulatory region from a different species, strain, or substrain of bacteria. In some embodiments, the genetically engineered bacteria comprise a RNS-sensing transcription factor and corresponding RNS-responsive regulatory region from a different species, strain, or substrain of bacteria. The heterologous RNS-sensing transcription factor and regulatory region may increase the transcription of genes operatively linked to said regulatory region in the presence of RNS, as compared to the native transcription factor and regulatory region from bacteria of the same subtype under the same conditions.

In some embodiments, the genetically engineered bacteria comprise a RNS-sensing transcription factor, NsrR, and corresponding regulatory region, nsrR, from *Neisseria gonorrhoeae*. In some embodiments, the native RNS-sensing transcription factor, e.g., NsrR, is left intact and retains wild-type activity. In alternate embodiments, the native RNS-sensing transcription factor, e.g., NsrR, is deleted or mutated to reduce or eliminate wild-type activity.

In some embodiments, the genetically engineered bacteria of the invention comprise multiple copies of the endogenous gene encoding the RNS-sensing transcription factor, e.g., the nsrR gene. In some embodiments, the gene encoding the RNS-sensing transcription factor is present on a plasmid. In some embodiments, the gene encoding the RNS-sensing transcription factor and the gene or gene cassette for producing the therapeutic molecule are present on different plasmids. In some embodiments, the gene encoding the RNS-sensing transcription factor and the gene or gene cassette for producing the therapeutic molecule are present on the same plasmid. In some embodiments, the gene encoding the RNS-sensing transcription factor is present on a chromosome. In some embodiments, the gene encoding the RNS-sensing transcription factor and the gene or gene cassette for producing the therapeutic molecule are present on different chromosomes. In some embodiments, the gene encoding the RNS-sensing transcription factor and the gene or gene cassette for producing the therapeutic molecule are present on the same chromosome.

In some embodiments, the genetically engineered bacteria comprise a wild-type gene encoding a RNS-sensing transcription factor, e.g., the NsrR gene, and a corresponding regulatory region, e.g., a norB regulatory region, that is mutated relative to the wild-type regulatory region from bacteria of the same subtype. The mutated regulatory region increases the expression of the payload(s) the presence of RNS, as compared to the wild-type regulatory region under the same conditions. In some embodiments, the genetically engineered bacteria comprise a wild-type RNS-responsive regulatory region, e.g., the norB regulatory region, and a corresponding transcription factor, e.g., NsrR, that is mutated relative to the wild-type transcription factor from bacteria of the same subtype. The mutant transcription factor increases the expression of the payload(s) in the presence of RNS, as compared to the wild-type transcription factor under the same conditions. In some embodiments, both the RNS-sensing transcription factor and corresponding regulatory region are mutated relative to the wild-type sequences from bacteria of the same subtype in order to increase expression of the payload(s) in the presence of RNS.

In some embodiments, the gene or gene cassette for producing the anti-inflammation and/or gut barrier function enhancer molecule is present on a plasmid and operably linked to a promoter that is induced by RNS. In some embodiments, expression is further optimized by methods known in the art, e.g., by optimizing ribosomal binding sites, manipulating transcriptional regulators, and/or increasing mRNA stability.

In some embodiments, any of the gene(s) of the present disclosure may be integrated into the bacterial chromosome at one or more integration sites. For example, one or more copies of a payload(s) may be integrated into the bacterial chromosome. Having multiple copies of the gene or gen(s) integrated into the chromosome allows for greater production of the payload(s) and also permits fine-tuning of the level of expression. Alternatively, different circuits described herein, such as any of the secretion or exporter circuits, in addition to the therapeutic gene(s) or gene cassette(s) could be integrated into the bacterial chromosome at one or more different integration sites to perform multiple different functions.

In some embodiments, the genetically engineered bacteria of the invention produce at least one anti-inflammation and/or gut barrier enhancer molecule in the presence of RNS to reduce local gut inflammation by at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold as compared to unmodified bacteria of the same subtype under the same conditions. Inflammation may be measured by methods known in the art, e.g., counting disease lesions using endoscopy; detecting T regulatory cell differentiation in peripheral blood, e.g., by fluorescence activated sorting; measuring T regulatory cell levels; measuring cytokine levels; measuring areas of mucosal damage; assaying inflammatory biomarkers, e.g., by qPCR; PCR arrays; transcription factor phosphorylation assays; immunoassays; and/or cytokine assay kits (Mesoscale, Cayman Chemical, Qiagen).

In some embodiments, the genetically engineered bacteria produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of an anti-inflammation and/or gut barrier enhancer molecule in the presence of RNS than unmodified bacteria of the same subtype under the same conditions. Certain unmodified bacteria will not have detectable levels of the anti-inflammation and/or gut barrier enhancer molecule. In embodiments using genetically modified forms of these bacteria, the anti-inflammation and/or gut barrier enhancer molecule will be detectable in the presence of RNS.

In certain embodiments, the anti-inflammation and/or gut barrier enhancer molecule is butyrate. Methods of measuring butyrate levels, e.g., by mass spectrometry, gas chromatography, high-performance liquid chromatography (HPLC), are known in the art (see, e.g., Aboulnaga et al., 2013). In some embodiments, butyrate is measured as butyrate level/bacteria optical density (OD). In some embodiments, measuring the activity and/or expression of one or more gene products in the butyrogenic gene cassette serves as a proxy measurement for butyrate production. In some embodiments, the bacterial cells of the invention are harvested and lysed to measure butyrate production. In alternate embodiments, butyrate production is measured in the bacterial cell medium. In some embodiments, the genetically engineered bacteria produce at least about 1 nM/OD, at least about 10 nM/OD, at least about 100 nM/OD, at least about 500 nM/OD, at least about 1 µM/OD, at least about 10 µM/OD, at least about 100 µM/OD, at least about 500 µM/OD, at least about 1 mM/OD, at least about 2 mM/OD, at least about 3 mM/OD, at least about 5 mM/OD, at least about 10 mM/OD, at least about 20 mM/OD, at least about 30 mM/OD, or at least about 50 mM/OD of butyrate in the presence of RNS.

ROS-Dependent Regulation

In some embodiments, the genetically engineered bacteria comprise gene, gene(s), or gene cassettes for producing the payload(s) that is expressed under the control of an inducible promoter. In some embodiments, the genetically engineered bacterium that expresses a payload(s) under the control of a promoter that is activated by conditions of cellular damage. In one embodiment, the one or more gene sequence(s) for producing the payload(s) is expressed under the control of a cellular damaged-dependent promoter that is activated in environments in which there is cellular or tissue damage, e.g., a reactive oxygen species or ROS promoter.

As used herein, "reactive oxygen species" and "ROS" are used interchangeably to refer to highly active molecules, ions, and/or radicals derived from molecular oxygen. ROS can be produced as byproducts of aerobic respiration or metal-catalyzed oxidation and may cause deleterious cellular effects such as oxidative damage. ROS includes, but is not limited to, hydrogen peroxide (H2O2), organic peroxide (ROOH), hydroxyl ion (OH—), hydroxyl radical (•OH), superoxide or superoxide anion (•O2-), singlet oxygen (1O2), ozone (O3), carbonate radical, peroxide or peroxyl radical (•O2-2), hypochlorous acid (HOCl), hypochlorite ion (OCl—), sodium hypochlorite (NaOCl), nitric oxide (NO•), and peroxynitrite or peroxynitrite anion (ONOO—) (unpaired electrons denoted by •). Bacteria have evolved transcription factors that are capable of sensing ROS levels. Different ROS signaling pathways are triggered by different ROS levels and occur with different kinetics (Marinho et al., 2014).

As used herein, "ROS-inducible regulatory region" refers to a nucleic acid sequence to which one or more ROS-sensing transcription factors is capable of binding, wherein the binding and/or activation of the corresponding transcription factor activates downstream gene expression; in the presence of ROS, the transcription factor binds to and/or activates the regulatory region. In some embodiments, the ROS-inducible regulatory region comprises a promoter sequence. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; in the presence of ROS, the transcription factor undergoes a conformational change, thereby activating downstream gene expression. The ROS-inducible regulatory region may be operatively linked to one or more gene sequence(s) for producing the payload(s). For example, in the presence of ROS, a transcription factor, e.g., OxyR, senses ROS and activates a corresponding ROS-inducible regulatory region, thereby driving expression of an operatively linked gene sequence or gene sequences. Thus, ROS induces expression of the gene or genes.

As used herein, "ROS-derepressible regulatory region" refers to a nucleic acid sequence to which one or more ROS-sensing transcription factors is capable of binding, wherein the binding of the corresponding transcription factor represses downstream gene expression; in the presence of ROS, the transcription factor does not bind to and does not repress the regulatory region. In some embodiments, the ROS-derepressible regulatory region comprises a promoter sequence. The ROS-derepressible regulatory region may be operatively linked to one or more gene sequence(s) for producing the payload(s). For example, in the presence of ROS, a transcription factor, e.g., OhrR, senses ROS and no longer binds to and/or represses the regulatory region, thereby derepressing an operatively linked gene sequence or gene cassette. Thus, ROS derepresses expression of the gene or gene cassette.

As used herein, "ROS-repressible regulatory region" refers to a nucleic acid sequence to which one or more ROS-sensing transcription factors is capable of binding, wherein the binding of the corresponding transcription factor represses downstream gene expression; in the presence of ROS, the transcription factor binds to and represses the regulatory region. In some embodiments, the ROS-repressible regulatory region comprises a promoter sequence. In some embodiments, the transcription factor that senses ROS is capable of binding to a regulatory region that overlaps with part of the promoter sequence. In alternate embodiments, the transcription factor that senses ROS is capable of binding to a regulatory region that is upstream or downstream of the promoter sequence. The ROS-repressible regulatory region may be operatively linked to a gene sequence or gene sequences. For example, in the presence of ROS, a transcription factor, e.g., PerR, senses ROS and binds to a corresponding ROS-repressible regulatory region, thereby blocking expression of an operatively linked gene sequence or gene sequences. Thus, ROS represses expression of the gene or gene sequence(s).

As used herein, a "ROS-responsive regulatory region" refers to a ROS-inducible regulatory region, a ROS-repressible regulatory region, and/or a ROS-derepressible regulatory region. In some embodiments, the ROS-responsive regulatory region comprises a promoter sequence. Each regulatory region is capable of binding at least one corresponding ROS-sensing transcription factor. Examples of transcription factors that sense ROS and their corresponding ROS-responsive genes, promoters, and/or regulatory regions include, but are not limited to, those shown in Table 28.

TABLE 28

Examples of ROS-sensing transcription factors and ROS-responsive genes

| ROS-sensing transcription factor: | Primarily capable of sensing: | Examples of responsive genes, promoters, and/or regulatory regions: |
|---|---|---|
| OxyR | $H_2O_2$ | ahpC; ahpF; dps; dsbG; fhuF; flu; fur; gor; grxA; hemH; katG; oxyS; sufA; sufB; sufC; sufD; sufE; sufS; trxC; uxuA; yaaA; yaeH; yaiA; ybjM; ydcH; ydeN; ygaQ; yljA; ytfK |
| PerR | $H_2O_2$ | katA; ahpCF; mrgA; zoaA; fur; hemAXCDBL; srfA |
| OhrR | Organic peroxides NaOCl | ohrA |
| SoxR | $•O_2^-$ NO• (also capable of sensing $H_2O_2$) | soxS |

TABLE 28-continued

Examples of ROS-sensing transcription factors and ROS-responsive genes

| ROS-sensing transcription factor: | Primarily capable of sensing: | Examples of responsive genes, promoters, and/or regulatory regions: |
|---|---|---|
| RosR | $H_2O_2$ | rbtT; tnp16a; rluC1; tnp5a; mscL; tnp2d; phoD; tnp15b; pstA; tnp5b; xylC; gabD1; rluC2; cgtS9; azlC; narKGHJI; rosR |

In some embodiments, the genetically engineered bacteria comprise a tunable regulatory region that is directly or indirectly controlled by a transcription factor that is capable of sensing at least one reactive oxygen species. The tunable regulatory region is operatively linked to a gene or gene cassette capable of directly or indirectly driving the expression of one or more payloads, thus controlling expression of the payload(s) relative to ROS levels. For example, the tunable regulatory region is a ROS-inducible regulatory region, and the molecule is butyrate; when ROS is present, e.g., in an inflamed tissue, a ROS-sensing transcription factor binds to and/or activates the regulatory region and drives expression of the gene sequence for the payload(s) thereby producing the payload(s). Subsequently, when inflammation is ameliorated, ROS levels are reduced, and production of the payload(s) is decreased or eliminated.

In some embodiments, the tunable regulatory region is a ROS-inducible regulatory region; in the presence of ROS, a transcription factor senses ROS and activates the ROS-inducible regulatory region, thereby driving expression of an operatively linked gene or gene cassette. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; when the transcription factor senses ROS, it undergoes a conformational change, thereby inducing downstream gene expression.

In some embodiments, the tunable regulatory region is a ROS-inducible regulatory region, and the transcription factor that senses ROS is OxyR. OxyR "functions primarily as a global regulator of the peroxide stress response" and is capable of regulating dozens of genes, e.g., "genes involved in H2O2 detoxification (katE, ahpCF), heme biosynthesis (hemH), reductant supply (grxA, gor, trxC), thiol-disulfide isomerization (dsbG), Fe—S center repair (sufA-E, sufS), iron binding (yaaA), repression of iron import systems (fur)" and "OxyS, a small regulatory RNA" (Dubbs et al., 2012). The genetically engineered bacteria may comprise any suitable ROS-responsive regulatory region from a gene that is activated by OxyR. Genes that are capable of being activated by OxyR are known in the art (see, e.g., Zheng et al., 2001; Dubbs et al., 2012; Table 1). In certain embodiments, the genetically engineered bacteria of the invention comprise a ROS-inducible regulatory region from oxyS that is operatively linked to one or more gene sequence(s) for producing the payload(s). In the presence of ROS, e.g., H2O2, an OxyR transcription factor senses ROS and activates to the oxyS regulatory region, thereby driving expression of the operatively linked payload(s) and producing the payload(s). In some embodiments, OxyR is encoded by an E. coli oxyR gene. In some embodiments, the oxyS regulatory region is an E. coli oxyS regulatory region. In some embodiments, the ROS-inducible regulatory region is selected from the regulatory region of katG, dps, and ahpC.

In alternate embodiments, the tunable regulatory region is a ROS-inducible regulatory region, and the corresponding transcription factor that senses ROS is SoxR. When SoxR is "activated by oxidation of its [2Fe-2S] cluster, it increases the synthesis of SoxS, which then activates its target gene expression" (Koo et al., 2003). "SoxR is known to respond primarily to superoxide and nitric oxide" (Koo et al., 2003), and is also capable of responding to H2O2. The genetically engineered bacteria of the invention may comprise any suitable ROS-responsive regulatory region from a gene that is activated by SoxR. Genes that are capable of being activated by SoxR are known in the art (see, e.g., Koo et al., 2003; Table 1). In certain embodiments, the genetically engineered bacteria of the invention comprise a ROS-inducible regulatory region from soxS that is operatively linked to a gene. In the presence of ROS, the SoxR transcription factor senses ROS and activates the soxS regulatory region, thereby driving expression of the operatively linked gene, gene(s), or gene cassettes for producing the payload(s) and producing the payload(s).

In some embodiments, the tunable regulatory region is a ROS-derepressible regulatory region, and binding of a corresponding transcription factor represses downstream gene expression; in the presence of ROS, the transcription factor no longer binds to the regulatory region, thereby derepressing the operatively linked gene or gene cassette.

In some embodiments, the tunable regulatory region is a ROS-derepressible regulatory region, and the transcription factor that senses ROS is OhrR. OhrR "binds to a pair of inverted repeat DNA sequences overlapping the ohrA promoter site and thereby represses the transcription event," but oxidized OhrR is "unable to bind its DNA target" (Duarte et al., 2010). OhrR is a "transcriptional repressor [that] . . . senses both organic peroxides and NaOCl" (Dubbs et al., 2012) and is "weakly activated by H2O2 but it shows much higher reactivity for organic hydroperoxides" (Duarte et al., 2010). The genetically engineered bacteria of the invention may comprise any suitable ROS-responsive regulatory region from a gene that is repressed by OhrR. Genes that are capable of being repressed by OhrR are known in the art (see, e.g., Dubbs et al., 2012; Table 1). In certain embodiments, the genetically engineered bacteria of the invention comprise a ROS-derepressible regulatory region from ohrA that is operatively linked to a gene or gene cassette. In the presence of ROS, e.g., NaOCl, an OhrR transcription factor senses ROS and no longer binds to the ohrA regulatory region, thereby derepressing the operatively linked gene, gene(s), or gene cassettes for producing the payload(s) and producing the payload(s).

OhrR is a member of the MarR family of ROS-responsive regulators. "Most members of the MarR family are transcriptional repressors and often bind to the −10 or −35 region in the promoter causing a steric inhibition of RNA polymerase binding" (Bussmann et al., 2010). Other members of this family are known in the art and include, but are not limited to, OspR, MgrA, RosR, and SarZ. In some embodiments, the transcription factor that senses ROS is OspR, MgRA, RosR, and/or SarZ, and the genetically engineered bacteria of the invention comprises one or more corresponding regulatory region sequences from a gene that is repressed by OspR, MgRA, RosR, and/or SarZ. Genes that are capable of being repressed by OspR, MgRA, RosR, and/or SarZ are known in the art (see, e.g., Dubbs et al., 2012).

In some embodiments, the tunable regulatory region is a ROS-derepressible regulatory region, and the corresponding transcription factor that senses ROS is RosR. RosR is "a MarR-type transcriptional regulator" that binds to an 18-bp inverted repeat with the consensus sequence TTGTTGAY-RYRTCAACWA (SEQ ID NO:289) and is "reversibly inhibited by the oxidant H2O2" (Bussmann et al., 2010). RosR is capable of repressing numerous genes and putative genes, including but not limited to "a putative polyisoprenoid-binding protein (cg1322, gene upstream of and divergent from rosR), a sensory histidine kinase (cgtS9), a putative transcriptional regulator of the Crp/FNR family (cg3291), a protein of the glutathione S-transferase family (cg1426), two putative FMN reductases (cg1150 and cg1850), and four putative monooxygenases (cg0823, cg1848, cg2329, and cg3084)" (Bussmann et al., 2010). The genetically engineered bacteria of the invention may comprise any suitable ROS-responsive regulatory region from a gene that is repressed by RosR. Genes that are capable of being repressed by RosR are known in the art (see, e.g., Bussmann et al., 2010; Table 1). In certain embodiments, the genetically engineered bacteria of the invention comprise a ROS-derepressible regulatory region from cgtS9 that is operatively linked to a gene or gene cassette. In the presence of ROS, e.g., H2O2, a RosR transcription factor senses ROS and no longer binds to the cgtS9 regulatory region, thereby derepressing the operatively linked gene, gene(s), or gene cassettes for producing the payload(s) and producing the payload(s).

In some embodiments, it is advantageous for the genetically engineered bacteria to express a ROS-sensing transcription factor that does not regulate the expression of a significant number of native genes in the bacteria. In some embodiments, the genetically engineered bacterium of the invention expresses a ROS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the ROS-sensing transcription factor is RosR, e.g., from *Corynebacterium glutamicum*, wherein the *Escherichia coli* does not comprise binding sites for said RosR. In some embodiments, the heterologous transcription factor minimizes or eliminates off-target effects on endogenous regulatory regions and genes in the genetically engineered bacteria.

In some embodiments, the tunable regulatory region is a ROS-repressible regulatory region, and binding of a corresponding transcription factor represses downstream gene expression; in the presence of ROS, the transcription factor senses ROS and binds to the ROS-repressible regulatory region, thereby repressing expression of the operatively linked gene or gene cassette. In some embodiments, the ROS-sensing transcription factor is capable of binding to a regulatory region that overlaps with part of the promoter sequence. In alternate embodiments, the ROS-sensing transcription factor is capable of binding to a regulatory region that is upstream or downstream of the promoter sequence.

In some embodiments, the tunable regulatory region is a ROS-repressible regulatory region, and the transcription factor that senses ROS is PerR. In *Bacillus subtilis*, PerR "when bound to DNA, represses the genes coding for proteins involved in the oxidative stress response (katA, ahpC, and mrgA), metal homeostasis (hemAXCDBL, fur, and zoaA) and its own synthesis (perR)" (Marinho et al., 2014). PerR is a "global regulator that responds primarily to H2O2" (Dubbs et al., 2012) and interacts with DNA at the per box, a specific palindromic consensus sequence (TTATAATNATTATAA (SEQ ID NO: 290)) residing within and near the promoter sequences of PerR-controlled genes Marinho et al., 2014). PerR is capable of binding a regulatory region that "overlaps part of the promoter or is immediately downstream from it" (Dubbs et al., 2012). The genetically engineered bacteria of the invention may comprise any suitable ROS-responsive regulatory region from a gene that is repressed by PerR. Genes that are capable of being repressed by PerR are known in the art (see, e.g., Dubbs et al., 2012; Table 1).

In these embodiments, the genetically engineered bacteria may comprise a two repressor activation regulatory circuit, which is used to express an amino acid catabolism enzyme. The two repressor activation regulatory circuit comprises a first ROS-sensing repressor, e.g., PerR, and a second repressor, e.g., TetR, which is operatively linked to a gene or gene cassette, e.g., or more payload(s). In one aspect of these embodiments, the ROS-sensing repressor inhibits transcription of the second repressor, which inhibits the transcription of the gene or gene cassette. Examples of second repressors useful in these embodiments include, but are not limited to, TetR, Cl, and LexA. In some embodiments, the ROS-sensing repressor is PerR. In some embodiments, the second repressor is TetR. In this embodiment, a PerR-repressible regulatory region drives expression of TetR, and a TetR-repressible regulatory region drives expression of the gene or gene cassette, e.g., an amino acid catabolism enzyme. In the absence of PerR binding (which occurs in the absence of ROS), tetR is transcribed, and TetR represses expression of the gene or gene cassette, e.g., one or more anti-inflammation and/or gut barrier enhancer molecule(s). In the presence of PerR binding (which occurs in the presence of ROS), tetR expression is repressed, and the gene or gene cassette is expressed.

A ROS-responsive transcription factor may induce, derepress, or repress gene expression depending upon the regulatory region sequence used in the genetically engineered bacteria. For example, although "OxyR is primarily thought of as a transcriptional activator under oxidizing conditions . . . OxyR can function as either a repressor or activator under both oxidizing and reducing conditions" (Dubbs et al., 2012), and OxyR "has been shown to be a repressor of its own expression as well as that of fhuF (encoding a ferric ion reductase) and flu (encoding the antigen 43 outer membrane protein)" (Zheng et al., 2001). The genetically engineered bacteria of the invention may comprise any suitable ROS-responsive regulatory region from a gene that is repressed by OxyR. In some embodiments, OxyR is used in a two repressor activation regulatory circuit, as described above. Genes that are capable of being repressed by OxyR are known in the art (see, e.g., Zheng et al., 2001; Table 1). Or, for example, although RosR is capable of repressing a number of genes, it is also capable of activating certain genes, e.g., the narKGHJI operon. In some embodiments, the genetically engineered bacteria comprise any suitable ROS-responsive regulatory region from a gene that is activated by RosR. In addition, "PerR-mediated positive regulation has also been observed . . . and appears to involve PerR binding to distant upstream sites" (Dubbs et al., 2012). In some embodiments, the genetically engineered bacteria comprise any suitable ROS-responsive regulatory region from a gene that is activated by PerR.

One or more types of ROS-sensing transcription factors and corresponding regulatory region sequences may be present in genetically engineered bacteria. For example, "OhrR is found in both Gram-positive and Gram-negative bacteria and can coreside with either OxyR or PerR or both" (Dubbs et al., 2012). In some embodiments, the genetically engineered bacteria comprise one type of ROS-sensing transcription factor, e.g., OxyR, and one corresponding regulatory region sequence, e.g., from oxyS. In some embodiments, the genetically engineered bacteria comprise one type of ROS-sensing transcription factor, e.g., OxyR, and two or more different corresponding regulatory region sequences, e.g., from oxyS and katG. In some embodiments, the genetically engineered bacteria comprise two or more types of ROS-sensing transcription factors, e.g., OxyR and PerR, and two or more corresponding regulatory region sequences, e.g., from oxyS and katA, respectively. One ROS-responsive regulatory region may be capable of binding more than one transcription factor. In some embodiments, the genetically engineered bacteria comprise two or more types of ROS-sensing transcription factors and one corresponding regulatory region sequence.

Nucleic acid sequences of several exemplary OxyR-regulated regulatory regions are shown in Table 29. OxyR binding sites are underlined and bolded. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 158, 159, 160, or 161, or a functional fragment thereof.

some instances, it may be advantageous to express the ROS-sensing transcription factor under the control of an inducible promoter in order to enhance expression stability. In some embodiments, expression of the ROS-sensing transcription factor is controlled by a different promoter than the promoter that controls expression of the therapeutic molecule. In some embodiments, expression of the ROS-sensing transcription factor is controlled by the same promoter that controls expression of the therapeutic molecule. In some embodiments, the ROS-sensing transcription factor and therapeutic molecule are divergently transcribed from a promoter region.

In some embodiments, the genetically engineered bacteria of the invention comprise a gene for a ROS-sensing transcription factor from a different species, strain, or substrain of bacteria. In some embodiments, the genetically engineered bacteria comprise a ROS-responsive regulatory region from a different species, strain, or substrain of bacteria. In some embodiments, the genetically engineered bacteria comprise a ROS-sensing transcription factor and corresponding ROS-responsive regulatory region from a different species, strain, or substrain of bacteria. The heterologous ROS-sensing transcription factor and regulatory region may increase the transcription of genes operatively linked to said regulatory region in the presence of ROS, as compared to the native transcription factor and regulatory region from bacteria of the same subtype under the same conditions.

TABLE 29

Nucleotide sequences of exemplary OxyR-regulated regulatory regions

| Regulatory sequence | 0123456789012345678901234567890123456789 |
|---|---|
| katG (SEQ ID NO: 158) | TGTGGCTTTTATGAAAATCACACAGTGATCACAAATTTTAAACA GAGCACAAAATGCTGCCTCGAAATGAGGGCGGGAAAATAAGGT TATCAGCCTTGTTTTCTCCCTCATTACTTGAAGGATATGAAGCTA AAACCCTTTTTTATAAAGCATTTGTCCGAATTCGGACATAATCA AAAAAGCTTAATTAAGATCAATTTGATCTACATCTCTTTAACCA ACAATATGTAAGATCTCAACTATCGCATCCGTGGATTAATTC AATTATAACTTCTCTCTAACGCTGTGTATCGTAACGGTAACACT GTAGAGGGGAGCACATTGATGCGAATTCATTAAAGAGGAGAAA GGTACC |
| dps (SEQ ID NO: 159) | TTCCGAAAATTCCTGGCGAGCAGATAAATAAGAATTGTTCTTAT CAATATATCTAACTCATTGAATCTTTATTAGTTTTGTTTTTCACG CTTGTTACCACTATTAGTGTGATAGGAACAGCCAGAATAGCG GAACACATAGCCGGTGCTATACTTAATCTCGTTAATTACTGGGA CATAACATCAAGAGGATATGAAATTCGAATTCATTAAAGAGGA GAAAGGTACC |
| ahpC (SEQ ID NO: 160) | GCTTAGATCAGGTGATTGCCCTTTGTTTATGAGGGTGTTGTAATC CATGTCGTTGTTGCATTTGTAAGGGCAACACCTCAGCCTGCAGG CAGGCACTGAAGATACCAAAGGGTAGTTCAGATTACACGGTCA CCTGGAAAGGGGGCCATTTTACTTTTTATCGCCGCTGGCGGTGC AAAGTTCACAAAGTTGTCTTACGAAGGTTGTAAGGTAAAACTT ATCGATTTGATAATGGAAACGCATTAGCCGAATCGGCAAAAAT TGGTTACCTTACATCTCATCGAAAACACGGAGGAAGTATAGATG CGAATTCATTAAAGAGGAGAAAGGTACC |
| oxyS (SEQ ID NO: 161) | CTCGAGTTCATTATCCATCCTCCATCGCCACGATAGTTCATGGC GATAGGTAGAATAGCAATGAACGATTATCCCTATCAAGCATTC TGACTGATAATTGCTCACACGAATTCATTAAAGAGGAGAAAGGT ACC |

In some embodiments, the genetically engineered bacteria of the invention comprise a gene encoding a ROS-sensing transcription factor, e.g., the oxyR gene, that is controlled by its native promoter, an inducible promoter, a promoter that is stronger than the native promoter, e.g., the GlnRS promoter or the P(Bla) promoter, or a constitutive promoter. In In some embodiments, the genetically engineered bacteria comprise a ROS-sensing transcription factor, OxyR, and corresponding regulatory region, oxyS, from *Escherichia coli*. In some embodiments, the native ROS-sensing transcription factor, e.g., OxyR, is left intact and retains wild-type activity. In alternate embodiments, the native ROS-sensing transcription factor, e.g., OxyR, is deleted or mutated to reduce or eliminate wild-type activity.

In some embodiments, the genetically engineered bacteria of the invention comprise multiple copies of the endogenous gene encoding the ROS-sensing transcription factor, e.g., the oxyR gene. In some embodiments, the gene encoding the ROS-sensing transcription factor is present on a plasmid. In some embodiments, the gene encoding the ROS-sensing transcription factor and the gene or gene cassette for producing the therapeutic molecule are present on different plasmids. In some embodiments, the gene encoding the ROS-sensing transcription factor and the gene or gene cassette for producing the therapeutic molecule are present on the same. In some embodiments, the gene encoding the ROS-sensing transcription factor is present on a chromosome. In some embodiments, the gene encoding the ROS-sensing transcription factor and the gene or gene cassette for producing the therapeutic molecule are present on different chromosomes. In some embodiments, the gene encoding the ROS-sensing transcription factor and the gene or gene cassette for producing the therapeutic molecule are present on the same chromosome.

In some embodiments, the genetically engineered bacteria comprise a wild-type gene encoding a ROS-sensing transcription factor, e.g., the soxR gene, and a corresponding regulatory region, e.g., a soxS regulatory region, that is mutated relative to the wild-type regulatory region from bacteria of the same subtype. The mutated regulatory region increases the expression of the one or more gene sequence(s) for producing the payload(s) in the presence of ROS, as compared to the wild-type regulatory region under the same conditions. In some embodiments, the genetically engineered bacteria comprise a wild-type ROS-responsive regulatory region, e.g., the oxyS regulatory region, and a corresponding transcription factor, e.g., OxyR, that is mutated relative to the wild-type transcription factor from bacteria of the same subtype. The mutant transcription factor increases the expression of the one or more gene sequence(s) for producing the payload(s) in the presence of ROS, as compared to the wild-type transcription factor under the same conditions. In some embodiments, both the ROS-sensing transcription factor and corresponding regulatory region are mutated relative to the wild-type sequences from bacteria of the same subtype in order to increase expression of the payload(s) in the presence of ROS.

In some embodiments, the one or more gene sequence(s) for producing the payload(s) are present on a plasmid and operably linked to a promoter that is induced by ROS. In some embodiments, the one or more gene sequence(s) for producing the payload(s) are present in the chromosome and operably linked to a promoter that is induced by ROS. In some embodiments, the one or more gene sequence(s) for producing the payload(s) are present on a chromosome and operably linked to a promoter that is induced by exposure to tetracycline. In some embodiments, the one or more gene sequence(s) for producing the payload(s) are present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria may comprise multiple copies of the one or more gene sequence(s) for producing the payload(s). In some embodiments, the one or more gene sequence(s) for producing the payload(s) are present on a plasmid and operatively linked to a ROS-responsive regulatory region. In some embodiments, the one or more gene sequence(s) for producing the payload(s) are present in a chromosome and operatively linked to a ROS-responsive regulatory region.

Thus, in some embodiments, the genetically engineered bacteria or genetically engineered virus produce one or more amino acid catabolism enzymes under the control of an oxygen level-dependent promoter, a reactive oxygen species (ROS)-dependent promoter, or a reactive nitrogen species (RNS)-dependent promoter, and a corresponding transcription factor.

In some embodiments, the genetically engineered bacteria comprise a stably maintained plasmid or chromosome carrying one or more gene sequence(s) for producing the payload(s) such that the one or more gene sequence(s) for producing the payload(s) can be expressed in the host cell, and the host cell is capable of survival and/or growth in vitro, e.g., in medium, and/or in vivo. In some embodiments, a bacterium may comprise multiple copies of the one or more gene sequence(s) for producing the payload(s). In some embodiments, the one or more gene sequence(s) for producing the payload(s) are expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, the one or more gene sequence(s) for producing the payload(s) are expressed on a high-copy plasmid. In some embodiments, the high-copy plasmid may be useful for increasing expression of the one or more gene sequence(s) for producing the payload(s). In some embodiments, the one or more gene sequence(s) for producing the payload(s) are expressed on a chromosome.

In some embodiments, the genetically engineered bacteria of the invention produce at least one anti-inflammation and/or gut barrier enhancer molecule in the presence of ROS to reduce local gut inflammation by at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold as compared to unmodified bacteria of the same subtype under the same conditions. Inflammation may be measured by methods known in the art, e.g., counting disease lesions using endoscopy; detecting T regulatory cell differentiation in peripheral blood, e.g., by fluorescence activated sorting; measuring T regulatory cell levels; measuring cytokine levels; measuring areas of mucosal damage; assaying inflammatory biomarkers, e.g., by qPCR; PCR arrays; transcription factor phosphorylation assays; immunoassays; and/or cytokine assay kits (Mesoscale, Cayman Chemical, Qiagen).

In some embodiments, the genetically engineered bacteria produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of an anti-inflammation and/or gut barrier enhancer molecule in the presence of ROS than unmodified bacteria of the same subtype under the same conditions. Certain unmodified bacteria will not have detectable levels of the anti-inflammation and/or gut barrier enhancer molecule. In embodiments using genetically modified forms of these bacteria, the anti-inflammation and/or gut barrier enhancer molecule will be detectable in the presence of ROS.

In certain embodiments, the anti-inflammation and/or gut barrier enhancer molecule is butyrate. Methods of measuring butyrate levels, e.g., by mass spectrometry, gas chromatography, high-performance liquid chromatography (HPLC), are known in the art (see, e.g., Aboulnaga et al., 2013). In some embodiments, butyrate is measured as butyrate level/bacteria optical density (OD). In some embodiments, measuring the activity and/or expression of one or more gene products in the butyrogenic gene cassette serves as a proxy measurement for butyrate production. In some embodiments, the bacterial cells of the invention are harvested and lysed to measure butyrate production. In alternate embodiments, butyrate production is measured in the bacterial cell medium. In some embodiments, the genetically engineered bacteria produce at least about 1 nM/OD, at least about 10 nM/OD, at least about 100 nM/OD, at least about 500 nM/OD, at least about 1 μM/OD, at least about 10 μM/OD, at least about 100 μM/OD, at least about 500 μM/OD, at least about 1 mM/OD, at least about 2 mM/OD, at least about 3 mM/OD, at least about 5 mM/OD, at least about 10 mM/OD, at least about 20 mM/OD, at least about 30 mM/OD, or at least about 50 mM/OD of butyrate in the presence of ROS.

Multiple Mechanisms of Action

Figure 47:
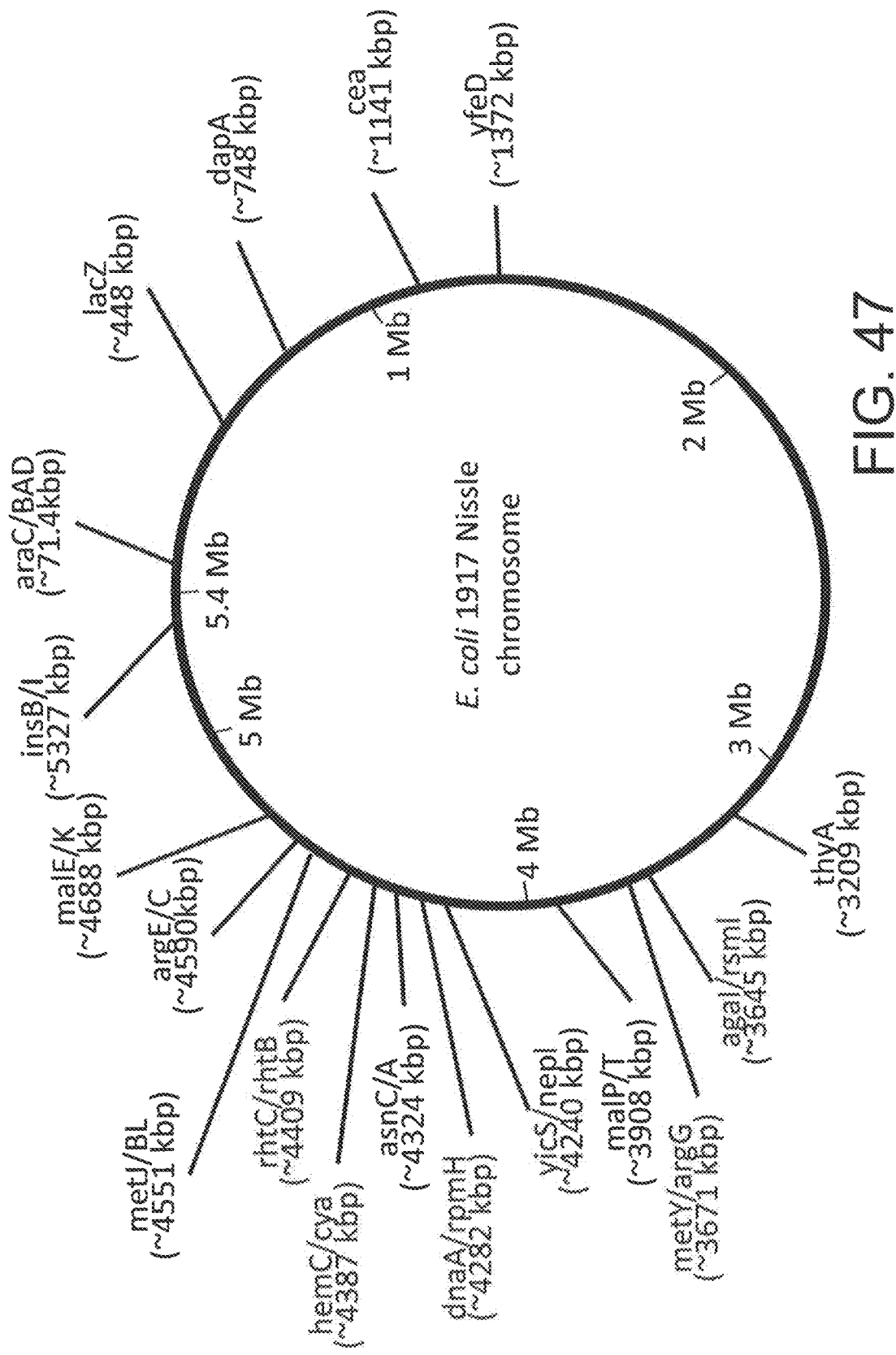
FIG. 47 depicts a map of integration sites within the *E. coli* Nissle chromosome. These sites indicate regions where circuit components may be inserted into the chromosome without interfering with essential gene expression. Backslashes (/) are used to show that the insertion will occur between divergently or convergently expressed genes. Insertions within biosynthetic genes, such as thyA, can be useful for creating nutrient auxotrophies. In some embodiments, an individual circuit component is inserted into more than one of the indicated sites.
Figure 48:
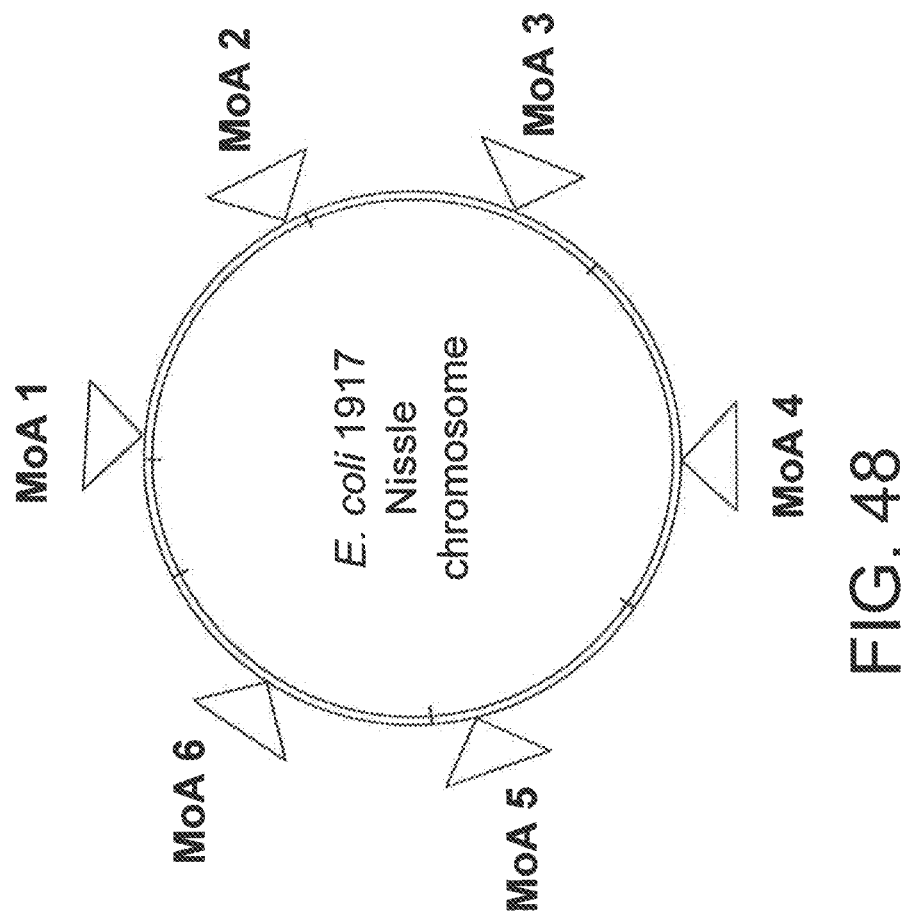
FIG. 48 depicts an exemplary schematic of the *E. coli* 1917 Nissle chromosome comprising multiple mechanisms of action (MoAs).
Figure 49A:
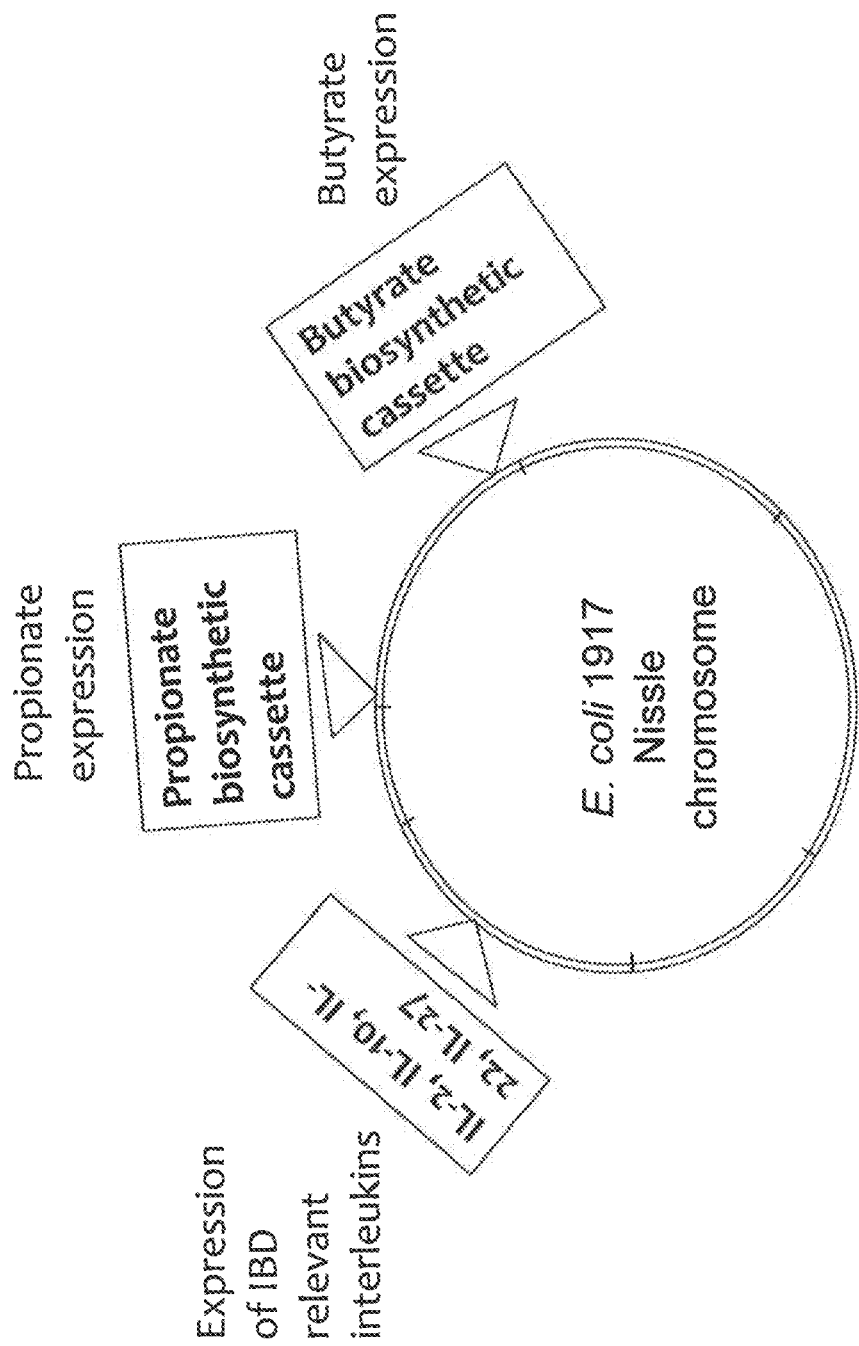
FIG. 49A and FIG. 49B depict schematics of bacterial chromosomes, for example the *E. coli* Nissle 1917 Chromosome. For example.
Figure 49B:
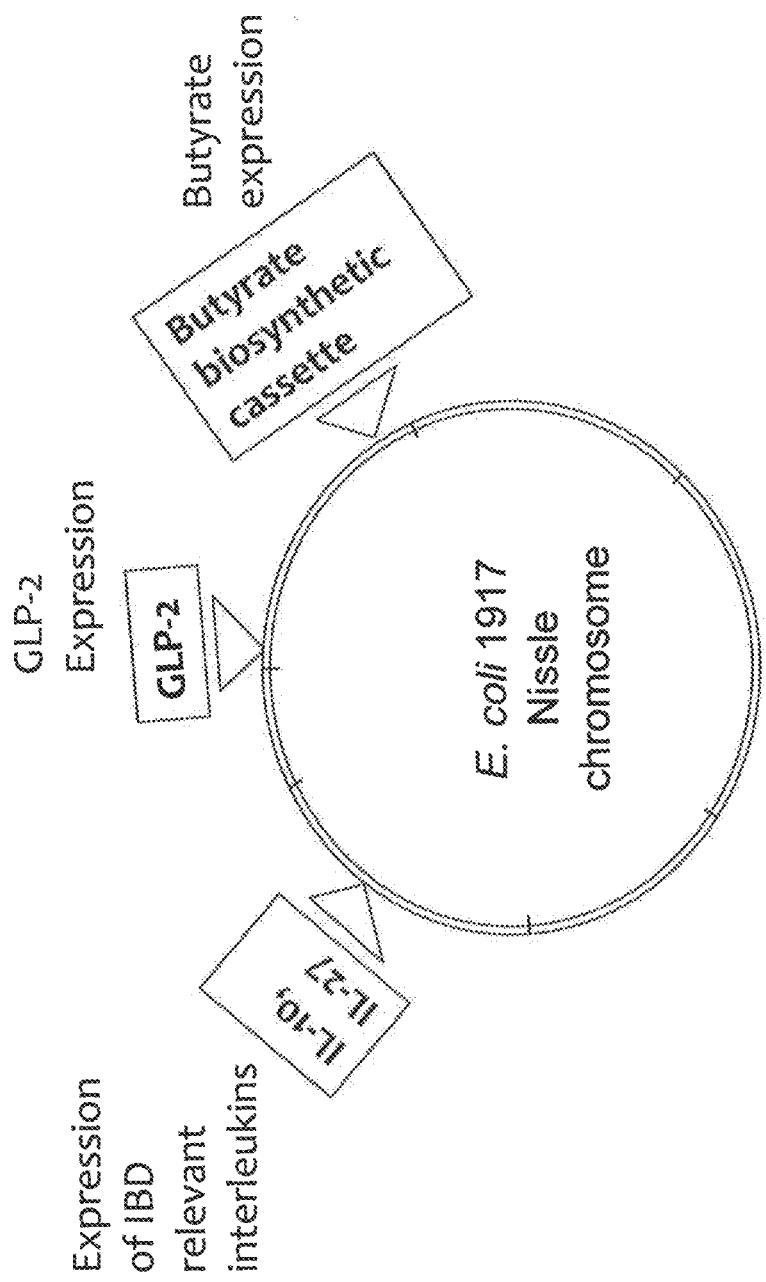
Figure 50:
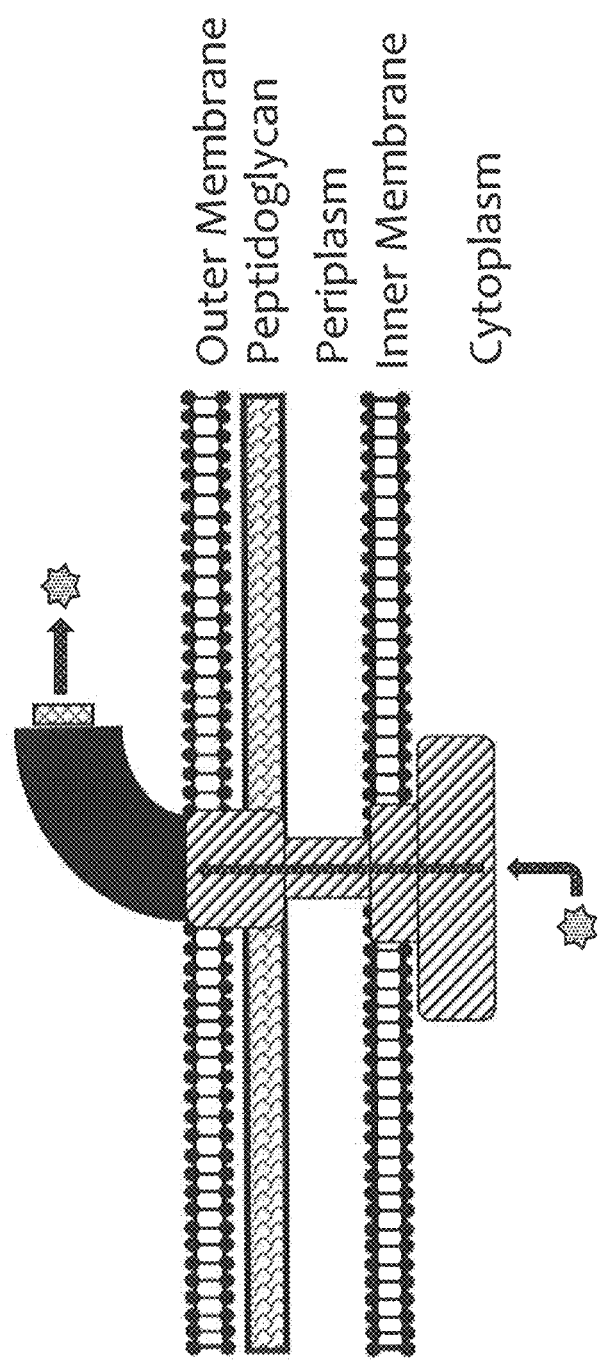
FIG. 50 depicts a schematic of a secretion system based on the flagellar type III secretion in which an incomplete flagellum is used to secrete a therapeutic peptide of interest (star) by recombinantly fusing the peptide to an N-terminal flagellar secretion signal of a native flagellar component so that the intracellularly expressed chimeric peptide can be mobilized across the inner and outer membranes into the surrounding host environment.

In some embodiments, the bacteria are genetically engineered to include multiple mechanisms of action (MOAs), e.g., circuits producing multiple copies of the same product (e.g., to enhance copy number) or circuits performing multiple different functions. Examples of insertion sites include, but are not limited to, malE/K, insB/I, araC/BAD, lacZ, dapA, cea, and other shown in FIG. 47. For example, the genetically engineered bacteria may include four copies of GLP-2 inserted at four different insertion sites, e.g., malE/K, insB/I, araC/BAD, and lacZ. Alternatively, the genetically engineered bacteria may include three copies of GLP-1 inserted at three different insertion sites, e.g., malE/K, insB/I, and lacZ, and three copies of a butyrogenic gene cassette inserted at three different insertion sites, e.g., dapA, cea, and araC/BAD.

In some embodiments, the bacteria are genetically engineered to include multiple mechanisms of action (MOAs), e.g., circuits producing multiple copies of the same product (e.g., to enhance copy number) or circuits performing multiple different functions. For example, the genetically engineered bacteria may include four copies of the gene, gene(s), or gene cassettes for producing the payload(s) inserted at four different insertion sites. Alternatively, the genetically engineered bacteria may include three copies of the gene, gene(s), or gene cassettes for producing the payload(s) inserted at three different insertion sites and three copies of the gene, gene(s), or gene cassettes for producing the payload(s) inserted at three different insertion sites.

In some embodiments, the genetically engineered bacteria comprise one or more of (1) one or more gene(s) or gene cassette(s) for the production of propionate, as described herein (2) one or more gene(s) or gene cassette(s) for the production of butyrate, as described herein (3) one or more gene(s) or gene cassette(s) for the production of acetate, as described herein (4) one or more gene(s) or gene cassette(s) for the production of tryptophan and/or its metabolites (including but not limited to kynurenine, indole, indole acetic acid, indole-3 aldehyde, and IPA), as described herein (5) one or more gene(s) or gene cassette(s) for the production of one or more of GLP-2 and GLP-2 analogs, as described herein (6) one or more gene(s) or gene cassette(s) for the production of human or viral or monommerized IL-10, as described herein (7) one or more gene(s) or gene cassette(s) for the production of human IL-22, as described herein (8) one or more gene(s) or gene cassette(s) for the production of IL-2, and/or SOD, and/or IL-27 and other interleukins, as described herein (9) one or more gene(s) or gene cassette(s) for the production of one or more transporters, e.g. for the import of tryptophan and/or metabolites as described herein (10) one or more polypeptides for secretion, including but not limited to GLP-2 and its analogs, IL-10, and/or IL-22, SCFA and/or tryptophan synthesis and/or catabolic enzymes in wild type or in mutated form (for increased stability or metabolic activity) (11) one or more components of secretion machinery, as described herein (12) one or more auxotrophies, e.g., deltaThyA (13) one more antibiotic resistances, including but not limited to, kanamycin or chloramphenicol resistance (14) one or more mutations/deletions to increase the flux through a metabolic pathway encoded by one or more genes or gene cassette(s), e.g mutations/deletions in genes in NADH consuming pathways, genes involved in feedback inhibition of a metabolic pathway encoded by the gene(s) or gene cassette(s) genes, as described herein (15) one or more mutations/deletions in one or more genes of the endogenous metabolic pathways, e.g., tryptophan synthesis pathway.

In some embodiments, the genetically engineered bacteria promote one or more of the following effector functions: (1) neutralizes TNF-α, IFN-γ, IL-1β, IL-6, IL-8, IL-17, and/or chemokines, e.g., CXCL-8 and CCL2 (2) activates include AHR (e.g., which result in IL-22 production) and (3) activates PXR, (4) inhibits HDACs, (5) activates GPR41 and/or GPR43 and/or GPR109A, (6) inhibits NF-kappaB signaling, (7) modulators of PPARgamma, (8) activates of AMPK signaling, (9) modulates GLP-1 secretion and/or (10). scavenges hydroxyl radicals and functions as antioxidants.

In some embodiments, under conditions where the gene, gene(s), or gene cassettes for producing the payload(s) is expressed, the genetically engineered bacteria of the disclosure produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of the payload(s) as compared to unmodified bacteria of the same subtype under the same conditions.

In some embodiments, quantitative PCR (qPCR) is used to amplify, detect, and/or quantify mRNA expression levels of the gene, gene(s), or gene cassettes for producing the payload(s). Primers may be designed and used to detect mRNA in a sample according to methods known in the art. In some embodiments, a fluorophore is added to a sample reaction mixture that may contain payload RNA, and a thermal cycler is used to illuminate the sample reaction mixture with a specific wavelength of light and detect the subsequent emission by the fluorophore. The reaction mixture is heated and cooled to predetermined temperatures for predetermined time periods. In certain embodiments, the heating and cooling is repeated for a predetermined number of cycles. In some embodiments, the reaction mixture is heated and cooled to 90-100° C., 60-70° C., and 30-50° C. for a predetermined number of cycles. In a certain embodiment, the reaction mixture is heated and cooled to 93-97° C., 55-65° C., and 35-45° C. for a predetermined number of cycles. In some embodiments, the accumulating amplicon is quantified after each cycle of the qPCR. The number of cycles at which fluorescence exceeds the threshold is the threshold cycle (CT). At least one CT result for each sample is generated, and the CT result(s) may be used to determine mRNA expression levels of the payload(s).

In some embodiments, quantitative PCR (qPCR) is used to amplify, detect, and/or quantify mRNA expression levels of the payload(s). Primers may be designed and used to detect mRNA in a sample according to methods known in the art. In some embodiments, a fluorophore is added to a sample reaction mixture that may contain payload mRNA, and a thermal cycler is used to illuminate the sample reaction mixture with a specific wavelength of light and detect the subsequent emission by the fluorophore. The reaction mixture is heated and cooled to predetermined temperatures for predetermined time periods. In certain embodiments, the heating and cooling is repeated for a predetermined number of cycles. In some embodiments, the reaction mixture is heated and cooled to 90-100° C., 60-70° C., and 30-50° C. for a predetermined number of cycles. In a certain embodiment, the reaction mixture is heated and cooled to 93-97° C., 55-65° C., and 35-45° C. for a predetermined number of cycles. In some embodiments, the accumulating amplicon is quantified after each cycle of the qPCR. The number of cycles at which fluorescence exceeds the threshold is the threshold cycle (CT). At least one CT result for each sample is generated, and the CT result(s) may be used to determine mRNA expression levels of the payload(s).

In some embodiments, the genetically engineered bacteria comprise gene sequence(s) encoding short chain fatty acid production enzymes described herein and/or one or more gene sequence(s) encoding tryptophan catabolism enzyme(s) described herein and one or more gene sequence(s) encoding metabolite transporters described herein, and/or one or more gene sequence(s) encoding one or more therapeutic peptides for secretion, as described herein.

In some embodiments, the genetically engineered bacteria comprise a butyrate gene cassette and are capable of producing butyrate. In some embodiments, the genetically engineered bacteria comprise a propionate gene cassette and are capable of producing propionate. In some embodiments, the genetically engineered bacteria comprise a acetate gene cassette and are capable of producing acetate. In some embodiments, the genetically engineered bacteria comprise a gene sequence encoding IL-10. In some embodiments, the genetically engineered bacteria comprise a gene sequence encoding IL-2. In some embodiments, the genetically engineered bacteria comprise a gene sequence encoding IL-22. In some embodiments, the genetically engineered bacteria comprise a gene sequence encoding IL-27. In some embodiments, the genetically engineered bacteria comprise a gene sequence encoding SOD. In some embodiments, the genetically engineered bacteria comprise a gene sequence encoding GLP-2. In some embodiments, the genetically engineered bacteria are capable of producing kyuernine.

In some embodiments, the genetically engineered bacteria comprise a butyrate gene cassette and are capable of producing butyrate and comprise a gene sequence encoding IL-10. In some embodiments, the genetically engineered bacteria comprise a butyrate gene cassette and are capable of producing butyrate and comprise a gene sequence encoding IL-2. In some embodiments, the genetically engineered bacteria comprise a butyrate gene cassette and are capable of producing butyrate and comprise a gene sequence encoding IL-22. In some embodiments, the genetically engineered bacteria comprise a butyrate gene cassette and are capable of producing butyrate and comprise a gene sequence encoding IL-27. In some embodiments, the genetically engineered bacteria comprise a butyrate gene cassette and are capable of producing butyrate and comprise a gene sequence encoding SOD. In some embodiments, the genetically engineered bacteria comprise a butyrate gene cassette and are capable of producing butyrate and comprise a gene sequence encoding GLP-2. In some embodiments, the genetically engineered bacteria comprise a butyrate gene cassette and are capable of producing butyrate and are capable of producing kyurenine.

In some embodiments, the genetically engineered bacteria comprise a butyrate gene cassette and are capable of producing butyrate and comprise a gene sequence encoding IL-10 and one or more gene sequences encoding IL-2, IL-22, IL-27, GLP-2, and SOD. In any of these embodiments the bacteria comprise a propionate gene cassette and can produce propionate. In any of these embodiments, the bacteria can produce kyuernine.

In some embodiments, the genetically engineered bacteria comprise a butyrate gene cassette and are capable of producing butyrate and comprise a gene sequence encoding IL-2 and one or more gene sequences encoding IL-10, IL-22, IL-27, GLP-2, and SOD. In any of these embodiments the bacteria comprise a propionate gene cassette and can produce propionate. In any of these embodiments, the bacteria can produce kyuernine. In some embodiments, the genetically engineered bacteria comprise a butyrate gene cassette and are capable of producing butyrate and comprise a gene sequence encoding IL-22 and one or more gene sequences encoding IL-2, IL-10, IL-27, GLP-2, and SOD. In any of these embodiments the bacteria comprise a propionate gene cassette and can produce propionate. In any of these embodiments, the bacteria can produce kyuernine. In some embodiments, the genetically engineered bacteria comprise a butyrate gene cassette and are capable of producing butyrate and comprise a gene sequence encoding IL-27 and one or more gene sequences encoding IL-2, IL-22, IL-10, GLP-2, and SOD. In any of these embodiments the bacteria comprise a propionate gene cassette and can produce propionate. In any of these embodiments, the bacteria can produce kyuernine. In some embodiments, the genetically engineered bacteria comprise a butyrate gene cassette and are capable of producing butyrate and comprise a gene sequence encoding GLP-2 and one or more gene sequences encoding IL-2, IL-22, IL-27, IL-10, and SOD. In any of these embodiments the bacteria comprise a propionate gene cassette and can produce propionate. In any of these embodiments, the bacteria can produce kyuernine.

In some embodiments, the genetically engineered bacteria comprise a butyrate gene cassette and are capable of producing butyrate and comprise a gene sequence encoding SOD and one or more gene sequences encoding IL-2, IL-22, IL-27, GLP-2, and IL-10. In any of these embodiments the bacteria comprise a propionate gene cassette and can produce propionate. In any of these embodiments, the bacteria can produce kyuernine.

In some embodiments, the genetically engineered bacteria comprise a gene sequence encoding IL-10 and a gene sequence(s) encoding one or more molecules selected from IL-2, IL-22, IL-27, GLP-2, and SOD. In some embodiments, the genetically engineered bacteria comprise a gene sequence encoding IL-2 and a gene sequence(s) encoding one or more molecules selected from IL-10, IL-22, IL-27, GLP-2, and SOD. In some embodiments, the genetically engineered bacteria comprise a gene sequence encoding IL-22 and a gene sequence(s) encoding one or more molecules selected from IL-2, IL-27, IL-10, GLP-2, and SOD. In some embodiments, the genetically engineered bacteria comprise a gene sequence(s) encoding IL-27 and a gene sequence encoding one or more molecules selected from IL-2, IL-22, IL-10, GLP-2, and SOD. In some embodiments, the genetically engineered bacteria comprise a gene sequence encoding SOD and a gene sequence(s) encoding one or more molecules selected from IL-2, IL-22, IL-27, GLP-2, and IL-10. In some embodiments, the genetically engineered bacteria comprise a gene sequence encoding GLP-2 and a gene sequence(s) encoding one or more molecules selected from IL-2, IL-22, IL-27, IL-10, and SOD. In any of these embodiments, the genetically engineered bacteria are capable of producing kyurenine. In any of these embodiments, the genetically engineered bacteria are capable of producing butyrate. In any of these embodiments, the genetically engineered bacteria are capable of producing propionate. In any of these embodiments, the genetically engineered bacteria are capable of producing acetate.

In some embodiments, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are expressed under the control of a constitutive promoter. In another embodiment, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are expressed under the control of an inducible promoter. In some embodiments, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are expressed under the control of a promoter that is directly or indirectly induced by exogenous environmental conditions. In one embodiment, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are expressed under the control of a promoter that is directly or indirectly induced by low-oxygen or anaerobic conditions, wherein expression of the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are activated under low-oxygen or anaerobic environments, such as the environment of the mammalian gut. In some embodiments, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are expressed under the control of a promoter that is directly or indirectly induced by inflammatory conditions. Exemplary inducible promoters described herein include oxygen level-dependent promoters (e.g., FNR-inducible promoter), promoters induced by inflammation or an inflammatory response (RNS, ROS promoters), and promoters induced by a metabolite that may or may not be naturally present (e.g., can be exogenously added) in the gut, e.g., arabinose and tetracycline. Examples of inducible promoters include, but are not limited to, an FNR responsive promoter, a $P_{araC}$ promoter, a $P_{araBAD}$ promoter, and a $P_{TetR}$ promoter, each of which are described in more detail herein. Inducible promoters are described in more detail infra.

The at least one gene encoding the at least one short chain fatty acid production enzyme(s) and/or tryptophan catabolism enzyme(s) and/or tryptophan biosynthesis enzyme(s) and/or metabolite transporters and/or therapeutic peptides for secretion may be present on a plasmid or chromosome in the bacterial cell. In one embodiment, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are located on a plasmid in the bacterial cell. In another embodiment, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are located in the chromosome of the bacterial cell. In yet another embodiment, a native copy of the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are located in the chromosome of the bacterial cell, and at least one gene encoding at least one short chain fatty acid production enzyme(s) and/or tryptophan catabolism enzyme(s) and/or tryptophan biosynthesis enzyme(s) and/or metabolite transporters and/or therapeutic peptides for secretion from a different species of bacteria are located on a plasmid in the bacterial cell. In yet another embodiment, a native copy of the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are located on a plasmid in the bacterial cell, and at least one gene encoding the at least one short chain fatty acid production enzyme(s) and/or tryptophan catabolism enzyme(s) and/or tryptophan biosynthesis enzyme(s) and/or metabolite transporters and/or therapeutic peptides for secretion from a different species of bacteria are located on a plasmid in the bacterial cell. In yet another embodiment, a native copy of the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are located in the chromosome of the bacterial cell, and at least one gene encoding the at least one short chain fatty acid production enzyme(s) and/or tryptophan catabolism enzyme(s) and/or tryptophan biosynthesis enzyme(s) and/or metabolite transporters and/or therapeutic peptides for secretion from a different species of bacteria are located in the chromosome of the bacterial cell.

In some embodiments, the gene sequence(s) encoding the one or more short chain fatty acid production enzyme(s) and/or tryptophan catabolism enzyme(s) and/or tryptophan biosynthesis enzyme(s) and/or metabolite transporters and/or therapeutic peptides for secretion are expressed on a low-copy plasmid. In some embodiments, the gene sequence(s) encoding the one or more short chain fatty acid production enzyme(s) and/or tryptophan biosynthesis enzyme(s) and/or metabolite transporters and/or therapeutic peptides for secretion are expressed on a high-copy plasmid. In some embodiments, the high-copy plasmid may be useful for increasing expression of the at least one short chain fatty acid production enzyme(s) and/or tryptophan catabolism enzyme(s) and/or tryptophan biosynthesis enzyme(s) and/or metabolite transporters and/or therapeutic peptides for secretion.

In some embodiments, a recombinant bacterial cell of the invention comprising at least one gene encoding at least one short chain fatty acid production enzyme(s) and/or tryptophan catabolism enzyme(s) and/or tryptophan biosynthesis enzyme(s) and/or metabolite transporters and/or therapeutic peptides for secretion are expressed on a high-copy plasmid do not increase tryptophan catabolism as compared to a recombinant bacterial cell comprising the same gene expressed on a low-copy plasmid in the absence of a heterologous importer of tryptophan and/or its metabolites and additional copies of a native importer of tryptophan and/or its metabolites. In alternate embodiments, the importer of tryptophan and/or its metabolites is used in conjunction with a high-copy plasmid.

In some embodiments, the genetically engineered bacteria described above further comprise one or more of the modifications, mutations, and/or deletions in endogenous genes described herein.

Secretion

In some embodiments, the genetically engineered bacteria further comprise a native secretion mechanism or non-native secretion mechanism that is capable of secreting a molecule from the bacterial cytoplasm in the extracellular environment. Many bacteria have evolved sophisticated secretion systems to transport substrates across the bacterial cell envelope. Substrates, such as small molecules, proteins, and DNA, may be released into the extracellular space or periplasm (such as the gut lumen or other space), injected into a target cell, or associated with the bacterial membrane.

In Gram-negative bacteria, secretion machineries may span one or both of the inner and outer membranes. In some embodiments, the genetically engineered bacteria further comprise a non-native double membrane-spanning secretion system. Membrane-spanning secretion systems include, but are not limited to, the type I secretion system (T1SS), the type II secretion system (T2SS), the type III secretion system (T3SS), the type IV secretion system (T4SS), the type VI secretion system (T6SS), and the resistance-nodulation-division (RND) family of multi-drug efflux pumps (Pugsley 1993; Gerlach et al., 2007; Collinson et al., 2015; Costa et al., 2015; Reeves et al., 2015; WO2014138324A1, incorporated herein by reference). Examples of such secretion systems are shown in FIG. 50, FIG. 51, FIG. 52, FIG. 53, and FIG. 54. Mycobacteria, which have a Gram-negative-like cell envelope, may also encode a type VII secretion system (T7SS) (Stanley et al., 2003). With the exception of the T2SS, double membrane-spanning secretions generally transport substrates from the bacterial cytoplasm directly into the extracellular space or into the target cell. In contrast, the T2SS and secretion systems that span only the outer membrane may use a two-step mechanism, wherein substrates are first translocated to the periplasm by inner membrane-spanning transporters, and then transferred to the outer membrane or secreted into the extracellular space. Outer membrane-spanning secretion systems include, but are not limited to, the type V secretion or autotransporter system or autosecreter system (T5SS), the curli secretion system, and the chaperone-usher pathway for pili assembly (Saier, 2006; Costa et al., 2015).

In some embodiments, the genetically engineered bacteria of the invention further comprise a type III or a type III-like secretion system (T3SS) from *Shigella, Salmonella, E. coli, Bivrio, Burkholderia, Yersinia, Chlamydia,* or *Pseudomonas*. The T3SS is capable of transporting a protein from the bacterial cytoplasm to the host cytoplasm through a needle complex. The T3SS may be modified to secrete the molecule from the bacterial cytoplasm, but not inject the molecule into the host cytoplasm. Thus, the molecule is secreted into the gut lumen or other extracellular space. In some embodiments, the genetically engineered bacteria comprise said modified T3SS and are capable of secreting the molecule of interest from the bacterial cytoplasm. In some embodiments, the secreted molecule, such as a heterologous protein or peptide comprises a type III secretion sequence that allows the molecule of interest o be secreted from the bacteria.

In some embodiments, a flagellar type III secretion pathway is used to secrete the molecule of interest. In some embodiments, an incomplete flagellum is used to secrete a therapeutic peptide of interest by recombinantly fusing the peptide to an N-terminal flagellar secretion signal of a native flagellar component. In this manner, the intracellularly expressed chimeric peptide can be mobilized across the inner and outer membranes into the surrounding host environment. For example, a modified flagellar type III secretion apparatus in which untranslated DNA fragment upstream of the gene fliC (encoding flagellin), e.g., a 173-bp region, is fused to the gene encoding the polypeptide of interest can be used to secrete heterologous polypeptides (See, e.g., Majander et al., Extracellular secretion of polypeptides using a modified *Escherichia coli* flagellar secretion apparatus. Nat Biotechnol. 2005 April; 23(4):475-81). In some cases, the untranslated region from the fliC loci, may not be sufficient to mediate translocation of the passenger peptide through the flagella. Here it may be necessary to extend the N-terminal signal into the amino acid coding sequence of FliC, for example using the 173 bp of untranslated region along with the first 20 amino acids of FliC (see, e.g., Duan et al., Secretion of Insulinotropic Proteins by Commensal Bacteria: Rewiring the Gut To Treat Diabetes, Appl. Environ. Microbiol. December 2008 vol. 74 no. 23 7437-7438).

Figure 51:
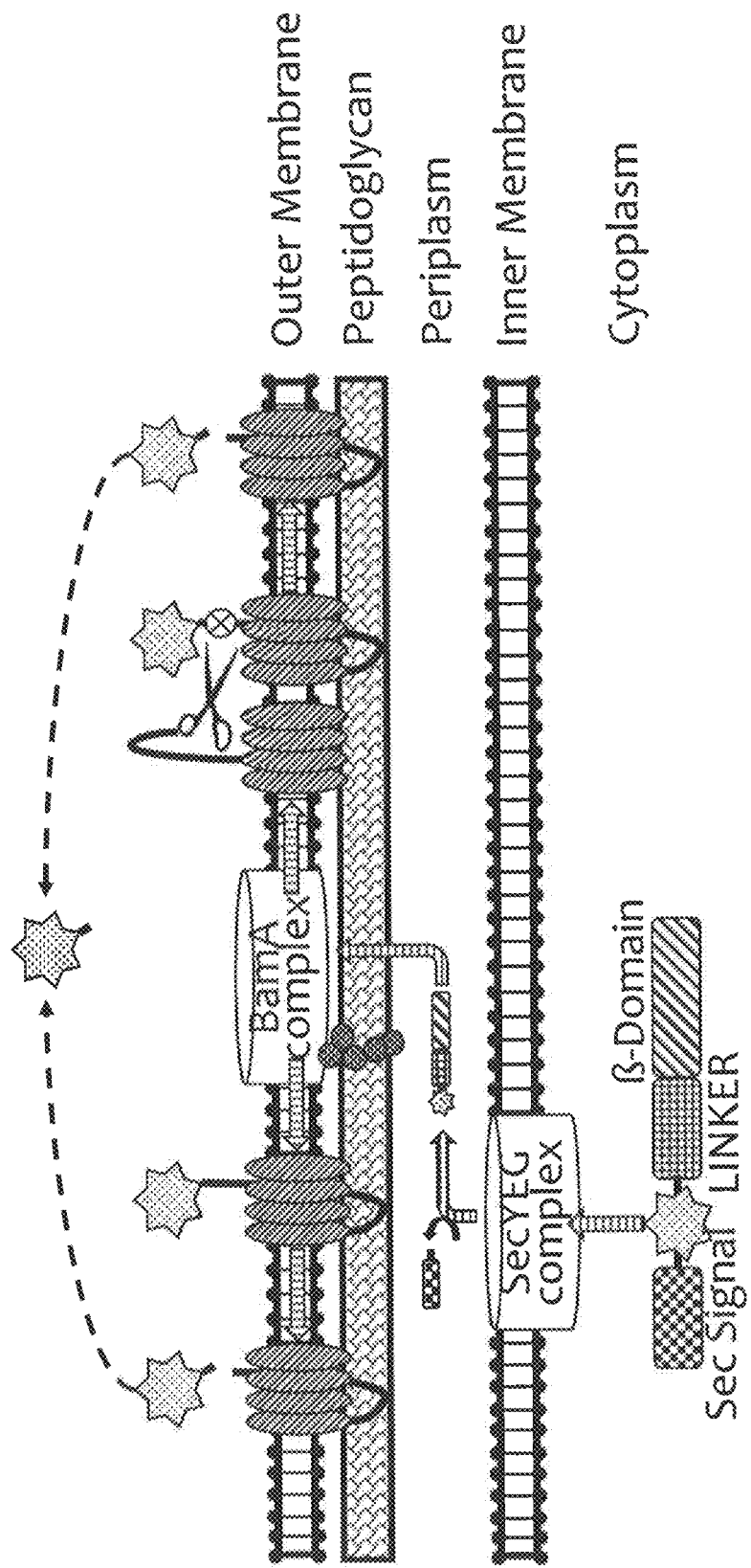
FIG. 51 depicts a schematic of a type V secretion system for the extracellular production of recombinant proteins in which a therapeutic peptide (star) can be fused to an N-terminal secretion signal, a linker and the beta-domain of an autotransporter. In this system, the N-terminal signal sequence directs the protein to the SecA-YEG machinery which moves the protein across the inner membrane into the periplasm, followed by subsequent cleavage of the signal sequence. The beta-domain is recruited to the Bam complex where the beta-domain is folded and inserted into the outer membrane as a beta-barrel structure. The therapeutic peptide is then thread through the hollow pore of the beta-barrel structure ahead of the linker sequence. The therapeutic peptide is freed from the linker system by an autocatalytic cleavage or by targeting of a membrane-associated peptidase (scissors) to a complementary protease cut site in the linker.

In some embodiments, a Type V Autotransporter Secretion System is used to secrete the molecule of interest, e.g., therapeutic peptide. Due to the simplicity of the machinery and capacity to handle relatively large protein fluxes, the Type V secretion system is attractive for the extracellular production of recombinant proteins. As shown in FIG. 51, a therapeutic peptide (star) can be fused to an N-terminal secretion signal, a linker, and the beta-domain of an autotransporter. The N-terminal, Sec-dependent signal sequence directs the protein to the SecA-YEG machinery which moves the protein across the inner membrane into the periplasm, followed by subsequent cleavage of the signal sequence. The Beta-domain is recruited to the Bam complex ('Beta-barrel assembly machinery') where the beta-domain is folded and inserted into the outer membrane as a beta-barrel structure. The therapeutic peptide is threaded through the hollow pore of the beta-barrel structure ahead of the linker sequence. Once exposed to the extracellular environment, the therapeutic peptide can be freed from the linker system by an autocatalytic cleavage (left side of Bam complex) or by targeting of a membrane-associated peptidase (black scissors; right side of Bam complex) to a complimentary protease cut site in the linker. Thus, in some embodiments, the secreted molecule, such as a heterologous protein or peptide comprises an N-terminal secretion signal, a linker, and beta-domain of an autotransporter so as to allow the molecule to be secreted from the bacteria.

Figure 52:
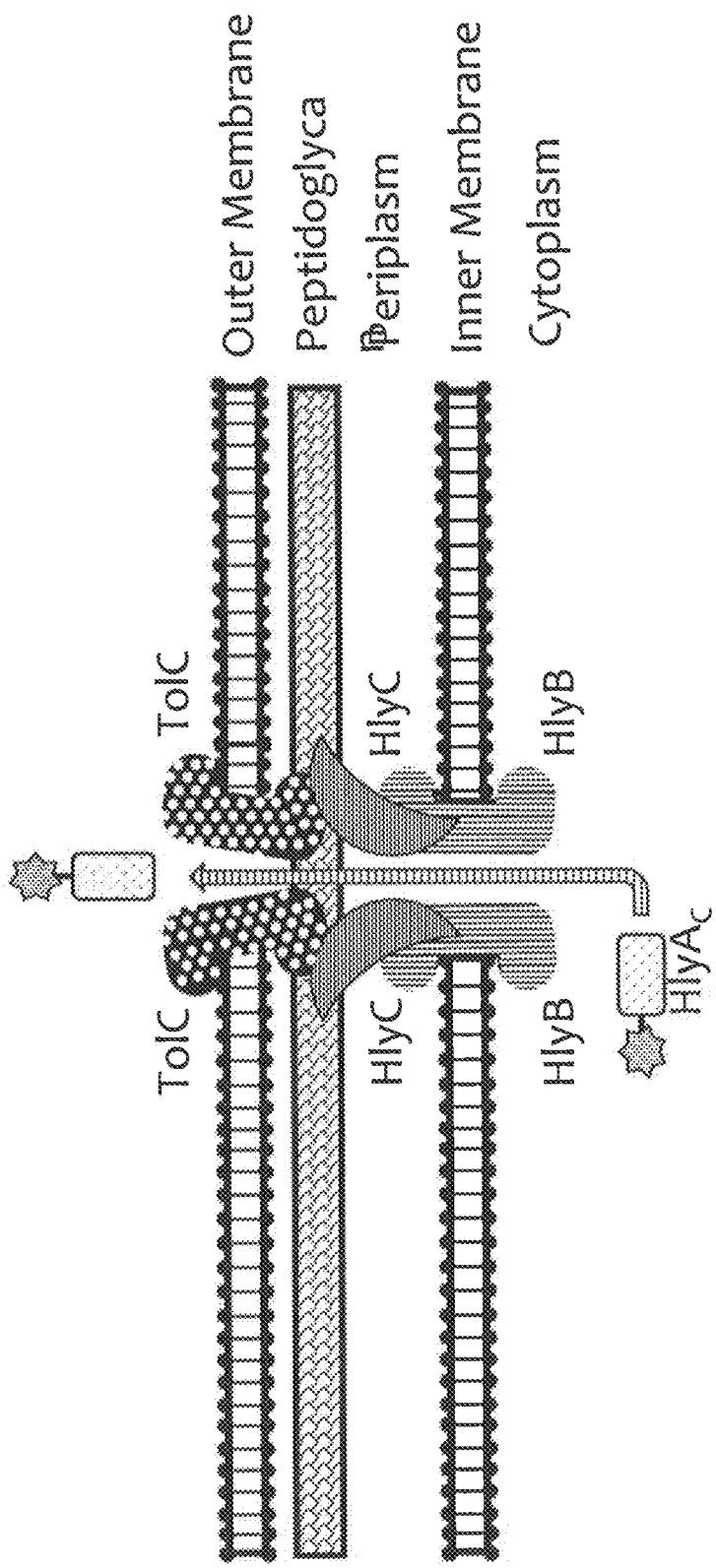
FIG. 52 depicts a schematic of a type I secretion system, which translocates a passenger peptide directly from the cytoplasm to the extracellular space using HlyB (an ATP-binding cassette transporter); HlyD (a membrane fusion protein); and TolC (an outer membrane protein) which form a channel through both the inner and outer membranes. The secretion signal-containing C-terminal portion of HlyA is fused to the C-terminal portion of a therapeutic peptide (star) to mediate secretion of this peptide.
Figure 53:
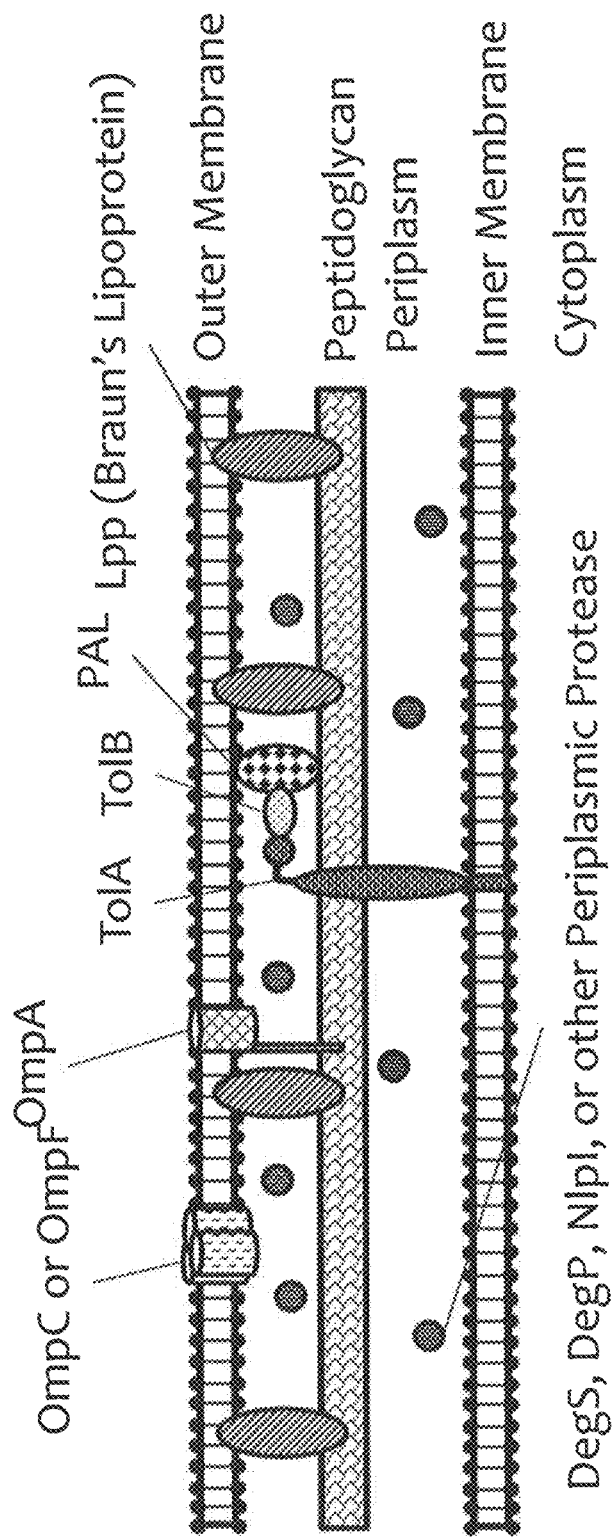
FIG. 53 depicts a schematic of the outer and inner membranes of a gram-negative bacterium, and several deletion targets for generating a leaky or destabilized outer membrane, thereby facilitating the translocation of a therapeutic polypeptides to the extracellular space, e.g., therapeutic polypeptides of eukaryotic origin containing disulphide bonds. Deactivating mutations of one or more genes encoding a protein that tethers the outer membrane to the peptidoglycan skeleton, e.g., lpp, ompC, ompA, ompF, tolA, tolB, pal, and/or one or more genes encoding a periplasmic protease, e.g., degS, degP, nlp1, generates a leaky phenotype. Combinations of mutations may synergistically enhance the leaky phenotype.
Figure 54:
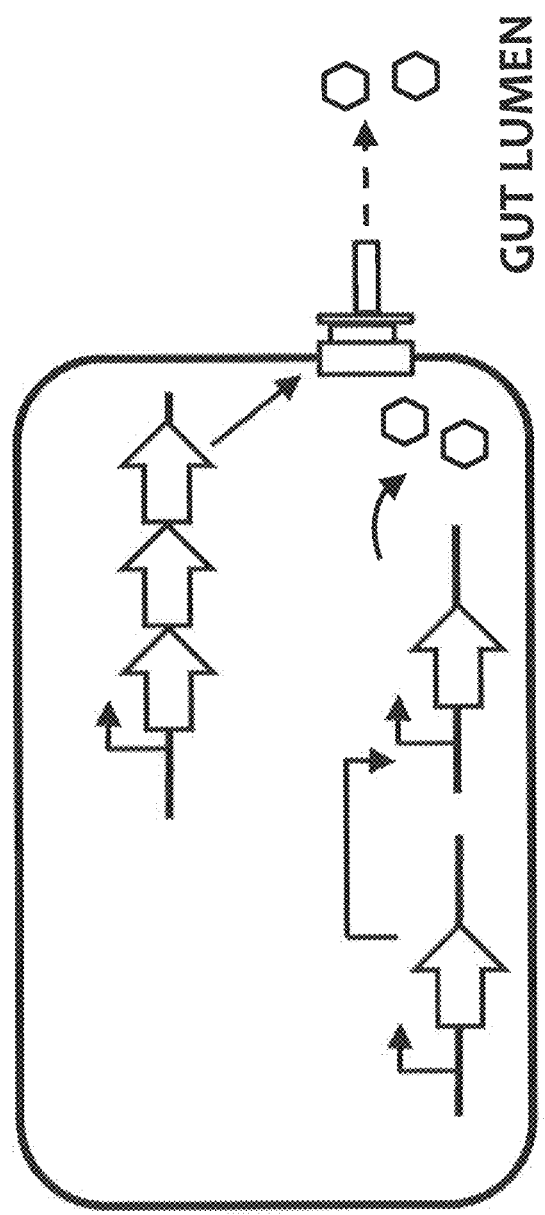
FIG. 54 depicts a modified type 3 secretion system (T3SS) to allow the bacteria to inject secreted therapeutic proteins into the gut lumen. An inducible promoter (small arrow, top), e.g. a FNR-inducible promoter, drives expression of the T3 secretion system gene cassette (3 large arrows, top) that produces the apparatus that secretes tagged peptides out of the cell. An inducible promoter (small arrow, bottom), e.g. a FNR-inducible promoter, drives expression of a regulatory factor, e.g. T7 polymerase, that then activates the expression of the tagged therapeutic peptide (hexagons).
Figure 55A:
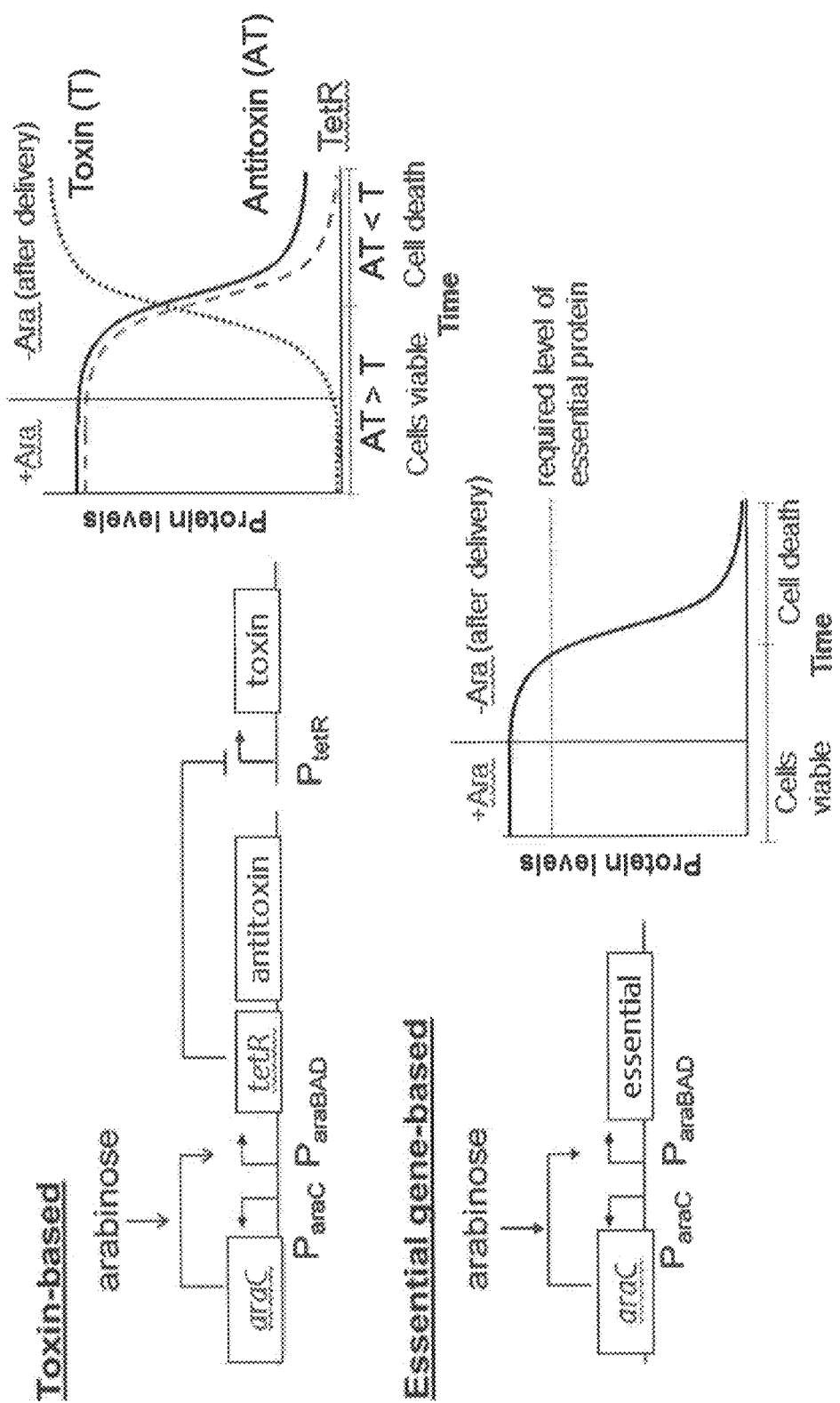
FIGS. 55A-55C depict other non-limiting embodiments of the disclosure, wherein the expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the ParaBAD promoter ($P_{araBAD}$), which induces expression of the Tet repressor (TetR) and an anti-toxin. The anti-toxin builds up in the recombinant bacterial cell, while TetR prevents expression of a toxin (which is under the control of a promoter having a TetR binding site). However, when arabinose is not present, both the anti-toxin and TetR are not expressed. Since TetR is not present to repress expression of the toxin, the toxin is expressed and kills the cell.
Figure 55B:
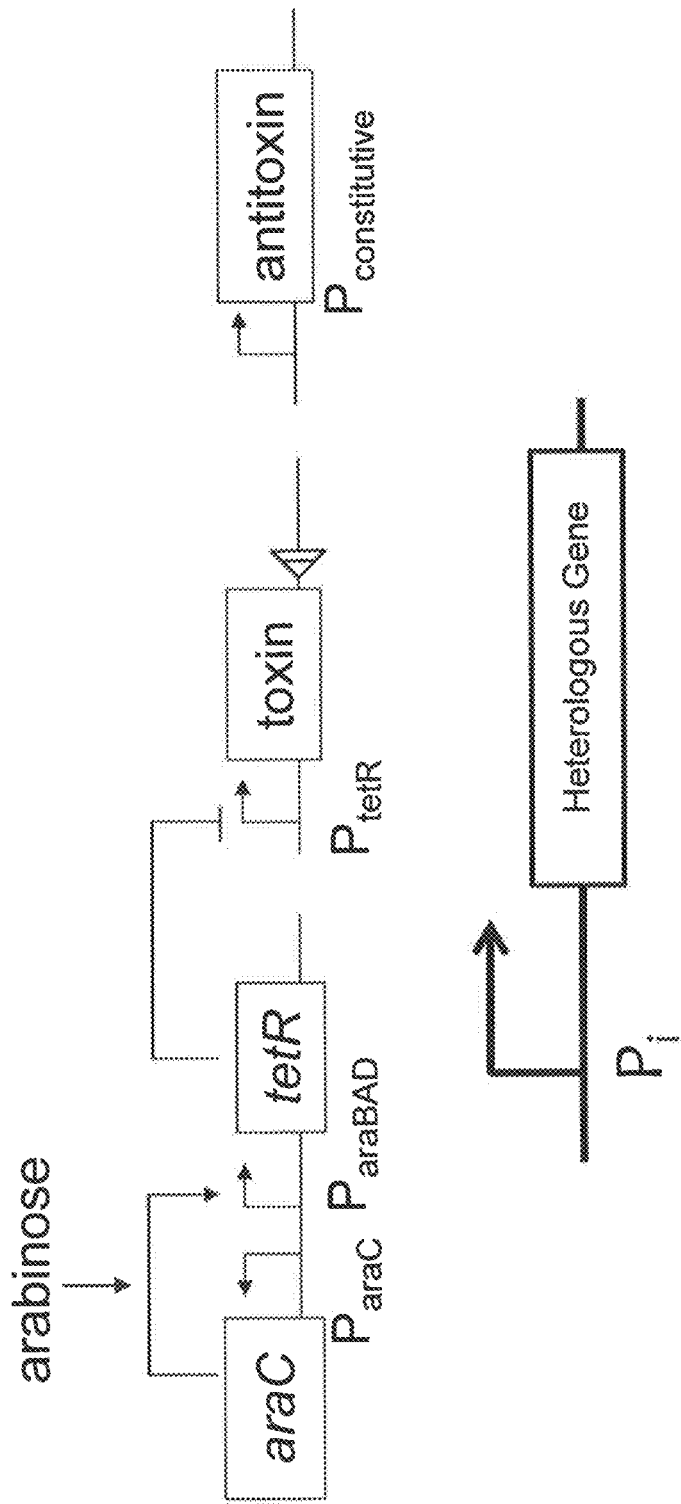
Figure 55C:
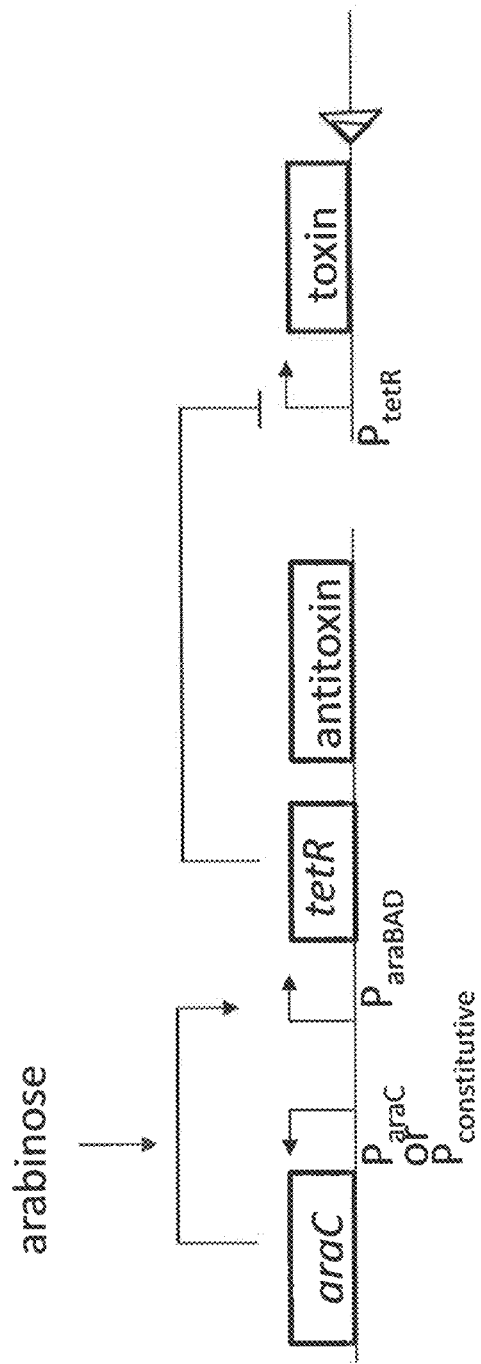

In some embodiments, a Hemolysin-based Secretion System is used to secrete the molecule of interest, e.g., therapeutic peptide. Type I Secretion systems offer the advantage of translocating their passenger peptide directly from the cytoplasm to the extracellular space, obviating the two-step process of other secretion types. FIG. 52 shows the alpha-hemolysin (HlyA) of uropathogenic *Escherichia coli*. This pathway uses HlyB, an ATP-binding cassette transporter; HlyD, a membrane fusion protein; and TolC, an outer membrane protein. The assembly of these three proteins forms a channel through both the inner and outer membranes. Natively, this channel is used to secrete HlyA, however, to secrete the therapeutic peptide of the present disclosure, the secretion signal-containing C-terminal portion of HlyA is fused to the C-terminal portion of a therapeutic peptide (star) to mediate secretion of this peptide.

In alternate embodiments, the genetically engineered bacteria further comprise a non-native single membrane-spanning secretion system. Single membrane-spanning transporters may act as a component of a secretion system, or may export substrates independently. Such transporters include, but are not limited to, ATP-binding cassette translocases, flagellum/virulence-related translocases, conjugation-related translocases, the general secretory system (e.g., the SecYEG complex in *E. coli*), the accessory secretory system in mycobacteria and several types of Gram-positive bacteria (e.g., *Bacillus anthracis, Lactobacillus johnsonii, Corynebacterium glutamicum, Streptococcus gordonii, Staphylococcus aureus*), and the twin-arginine translocation (TAT) system (Saier, 2006; Rigel and Braunstein, 2008; Albiniak et al., 2013). It is known that the general secretory and TAT systems can both export substrates with cleavable N-terminal signal peptides into the periplasm, and have been explored in the context of biopharmaceutical production. The TAT system may offer particular advantages, however, in that it is able to transport folded substrates, thus eliminating the potential for premature or incorrect folding. In certain embodiments, the genetically engineered bacteria comprise a TAT or a TAT-like system and are capable of secreting the molecule of interest from the bacterial cytoplasm. One of ordinary skill in the art would appreciate that the secretion systems disclosed herein may be modified to act in different species, strains, and subtypes of bacteria, and/or adapted to deliver different payloads.

In order to translocate a protein, e.g., therapeutic polypeptide, to the extracellular space, the polypeptide must first be translated intracellularly, mobilized across the inner membrane and finally mobilized across the outer membrane. Many effector proteins (e.g., therapeutic polypeptides)—particularly those of eukaryotic origin—contain disulphide bonds to stabilize the tertiary and quaternary structures. While these bonds are capable of correctly forming in the oxidizing periplasmic compartment with the help of periplasmic chaperones, in order to translocate the polypeptide across the outer membrane the disulphide bonds must be reduced and the protein unfolded again.

One way to secrete properly folded proteins in gram-negative bacteria—particularly those requiring disulphide bonds—is to target the reducing-environment periplasm in conjunction with a destabilizing outer membrane. In this manner the protein is mobilized into the oxidizing environment and allowed to fold properly. In contrast to orchestrated extracellular secretion systems, the protein is then able to escape the periplasmic space in a correctly folded form by membrane leakage. These "leaky" gram-negative mutants are therefore capable of secreting bioactive, properly disulphide-bonded polypeptides. In some embodiments, the genetically engineered bacteria have a "leaky" or de-stabilized outer membrane. Destabilizing the bacterial outer membrane to induce leakiness can be accomplished by deleting or mutagenizing genes responsible for tethering the outer membrane to the rigid peptidoglycan skeleton, including for example, lpp, ompC, ompA, ompF, tolA, tolB, pal, degS, degP, and nlp1. Lpp is the most abundant polypeptide in the bacterial cell existing at ~500,000 copies per cell and functions as the primary 'staple' of the bacterial cell wall to the peptidoglycan. 1. Silhavy, T. J., Kahne, D. & Walker, S. The bacterial cell envelope. Cold Spring Harb Perspect Biol 2, a000414 (2010). TolA-PAL and OmpA complexes function similarly to Lpp and are other deletion targets to generate a leaky phenotype. Additionally, leaky phenotypes have been observed when periplasmic proteases are inactivated. The periplasm is very densely packed with protein and therefore encode several periplasmic proteins to facilitate protein turnover. Removal of periplasmic proteases such as degS, degP or nlpI can induce leaky phenotypes by promoting an excessive build-up of periplasmic protein. Mutation of the proteases can also preserve the effector polypeptide by preventing targeted degradation by these proteases. Moreover, a combination of these mutations may synergistically enhance the leaky phenotype of the cell without major sacrifices in cell viability. Thus, in some embodiments, the engineered bacteria have one or more deleted or mutated membrane genes. In some embodiments, the engineered bacteria have a deleted or mutated lpp gene. In some embodiments, the engineered bacteria have one or more deleted or mutated gene(s), selected from ompA, ompA, and ompF genes. In some embodiments, the engineered bacteria have one or more deleted or mutated gene(s), selected from tolA, tolB, and pal genes. in some embodiments, the engineered bacteria have one or more deleted or mutated periplasmic protease genes. In some embodiments, the engineered bacteria have one or more deleted or mutated periplasmic protease genes selected from degS, degP, and nlp1. In some embodiments, the engineered bacteria have one or more deleted or mutated gene(s), selected from lpp, ompA, ompF, tolA, tolB, pal, degS, degP, and nlp1 genes.

To minimize disturbances to cell viability, the leaky phenotype can be made inducible by placing one or more membrane or periplasmic protease genes, e.g., selected from lpp, ompA, ompF, tolA, tolB, pal, degS, degP, and nlp1, under the control of an inducible promoter. For example, expression of lpp or other cell wall stability protein or periplasmic protease can be repressed in conditions where the therapeutic polypeptide needs to be delivered (secreted). For instance, under inducing conditions a transcriptional repressor protein or a designed antisense RNA can be expressed which reduces transcription or translation of a target membrane or periplasmic protease gene. Conversely, overexpression of certain peptides can result in a destabilized phenotype, e.g., over expression of colicins or the third topological domain of TolA, which peptide overexpression can be induced in conditions in which the therapeutic polypeptide needs to be delivered (secreted). These sorts of strategies would decouple the fragile, leaky phenotypes from biomass production. Thus, in some embodiments, the engineered bacteria have one or more membrane and/or periplasmic protease genes under the control of an inducible promoter.

The Table 30 and Table 31 below lists secretion systems for Gram positive bacteria and Gram negative bacteria.

TABLE 30

Secretion systems for gram positive bacteria

| Bacterial Strain | Relevant Secretion System |
|---|---|
| C. novyi-NT (Gram+) | Sec pathway<br>Twin- arginine (TAT) pathway |
| C. butryicum (Gram+) | Sec pathway<br>Twin- arginine (TAT) pathway |
| Listeria monocytogenes (Gram+) | Sec pathway<br>Twin- arginine (TAT) pathway |

TABLE 31

Secretion Systems for Gram negative bacteria
Protein secretary pathways (SP) in gram-negative bacteria and their descendants

| Type (Abbreviation) | Name | TC#[2] | Bacteria | Archaea | Eukarya | # Proteins/ System | Energy Source |
|---|---|---|---|---|---|---|---|
| IMPS - Gram-negative bacterial inner membrane channel-forming translocases ||||||||
| ABC (SIP) | ATP binding cassette translocase | 3.A.1 | + | + | + | 3-4 | ATP |
| SEC (IISP) | General secretory translocase | 3.A.5 | + | + | + | ~12 | GTP OR ATP + PMF |
| Fla/Path (IIISP) | Flagellum/ virulence- related translocase | 3.A.6 | + | − | − | >10 | ATP |
| Conj (IVSP) | Conjugation- related translocase | 3.A.7 | + | − | − | >10 | ATP |
| Tat (IISP) | Twin- arginine targeting translocase | 2.A.64 | + | + | + (chloroplasts) | 2-4 | PMF |
| Oxa1 (YidC) | Cytochrome oxidase biogenesis family | 2.A.9 | + | + | + (mitochondria chloroplasts) | 1 | None or PMF |
| MscL | Large conductance mechanosensitive channel family | 1.A.22 | + | + | + | 1 | None |
| Holins | Holin functional superfamily | 1.E.1•21 | + | − | − | 1 | None |
| Eukaryotic Organelles ||||||||
| MPT | Mitochondrial protein translocase | 3.A.B | − | − | + (mitochondrial) | >20 | ATP |
| CEPT | Chloroplast envelope protein translocase | 3.A.9 | (+) | − | + (chloroplasts) | ≥3 | GTP |
| Bcl-2 | Eukaryotic Bcl-2 family (programmed cell death) | 1.A.21 | − | − | + | 1? | None |
| Gram-negative bacterial outer membrane channel-forming translocases ||||||||
| MTB (IISP) | Main terminal branch of the general secretory translocase | 3.A.15 | +[b] | − | − | ~14 | ATP; PMF |
| FUP AT-1 | Fimbrial usher protein Auto- transporter-1 | 1.B.11<br>1.B.12 | +[b]<br>+[b] | −<br>− | −<br>− | 1<br>1 | None<br>None |
| AT-2 | Auto- transporter-2 | 1.B.40 | +[b] | − | − | 1 | None |
| OMF (ISP) | | 1.B.17 | +[b] | − | +(?) | 1 | None |

TABLE 31-continued

Secretion Systems for Gram negative bacteria
Protein secretary pathways (SP) in gram-negative bacteria and their descendants

| Type (Abbreviation) | Name | TC#[2] | Bacteria | Archaea | Eukarya | # Proteins/ System | Energy Source |
|---|---|---|---|---|---|---|---|
| TPS | | 1.B.2 | + | − | + | 1 | None |
| Secretin (IISP and IISP) | | 1.B.22 | +[b] | | − | 1 | None |
| OmpIP | Outer membrane insertion porin | 1.B.33 | + | − | + (mitochondria; chloroplasts) | ≥4 | None ? |

The above tables for gram positive and gram negative bacteria list secretion systems that can be used to secrete polypeptides and other molecules from the engineered bacteria, which are reviewed in Milton H. Saier, Jr. Microbe/ Volume 1, Number 9, 2006 "Protein Secretion Systems in Gram-Negative Bacteria Gram-negative bacteria possess many protein secretion-membrane insertion systems that apparently evolved independently", the contents of which is herein incorporated by reference in its entirety.

Any of the secretion systems described herein may according to the disclosure be employed to secrete the proteins of interest. Non-limiting examples of proteins of interest include GLP-2 peptides, GLP-2 analogs, IL-22, vIL-10, hIL-10, monomerized IL-10, IL-27, IL-19, IL-20, IL-24, tryptophan synthesies enzymes, SCFA biosynthesis enzymes, tryptophan catabolic enzymes, including but not limited to IDO, TDO, kynureninase, other tryptophan pathway catabolic enzymes, e.g. in the indole pathway and/or the kynurenine pathway as described herein. These polypeptides may be mutated to increase stability, resistance to protease digestion, and/or activity.

TABLE 32

Comparison of Secretion systems for secretion of polypeptide from engineered bacteria

| Secretion System | Tag | Cleavage | Advantages | Other features |
|---|---|---|---|---|
| Modified Type III (flagellar) | mRNA (or N-terminal) | No cleavage necessary | No peptide tag Endogenous | May not be as suited for larger proteins Deletion of flagellar genes |
| Type V auto-transport | N- and C-terminal | Yes | Large proteins Endogenous Cleavable | 2-step secretion |
| Type I | C-terminal | No | | Tag; Exogenous Machinery |
| Diffusible Outer Membrane (DOM) | N-terminal | Yes | Disulfide bond formation | May affect cell fragility/ survivability/ growth/yield |

In some embodiments, the therapeutic polypeptides of interest are secreted using components of the flagellar type III secretion system. In a non-limiting example, such a therapeutic polypeptide of interest, such as, GLP-2 peptides, GLP-2 analogs, IL-22, vIL-10, hIL-10, monomerized IL-10, IL-27, IL-19, IL-20, IL-24, is assembled behind a fliC-5'UTR (e.g., 173-bp untranslated region from the fliC loci), and is driven by the native promoter. In other embodiments, the expression of the therapeutic peptide of interested secreted using components of the flagellar type III secretion system is driven by a tet-inducible promoter. In alternate embodiments, an inducible promoter such as oxygen level-dependent promoters (e.g., FNR-inducible promoter), promoters induced by IBD specific molecules or promoters induced by inflammation or an inflammatory response (RNS, ROS promoters), and promoters induced by a metabolite that may or may not be naturally present (e.g., can be exogenously added) in the gut, e.g., arabinose is used. In some embodiments, the therapeutic polypeptide of interest is expressed from a plasmid (e.g., a medium copy plasmid). In some embodiments, the therapeutic polypeptide of interest is expressed from a construct which is integrated into fliC locus (thereby deleting fliC), where it is driven by the native FliC promoter. In some embodiments, an N terminal part of FliC (e.g., the first 20 amino acids of FliC) is included in the construct, to further increase secretion efficiency.

In some embodiments, the therapeutic polypeptides of interest, e.g., GLP-2 peptides, GLP-2 analogs, IL-22, vIL-10, hIL-10, monomerized IL-10, IL-27, IL-19, IL-20, IL-24, are secreted using via a diffusible outer membrane (DOM) system. In some embodiments, the therapeutic polypeptide of interest is fused to a N-terminal Sec-dependent secretion signal. Non-limiting examples of such N-terminal Sec-dependent secretion signals include PhoA, OmpF, OmpA, and cvaC. In alternate embodiments, the therapeutic polypeptide of interest is fused to a Tat-dependent secretion signal. Exemplary Tat-dependent tags include TorA, FdnG, and DmsA. In some embodiments, expression of the secretion-tagged therapeutic protein is driven by a tet promoter or an inducible promoter, such as oxygen level-dependent promoters (e.g., FNR-inducible promoter), or by promoters induced by IBD specific molecules or promoters induced by inflammation or an inflammatory response (RNS, ROS promoters), and promoters induced by a metabolite that may or may not be naturally present (e.g., can be exogenously added) in the gut, e.g., arabinose. In some embodiments, the secretion-tagged therapeutic polypeptide of interest is expressed from a plasmid (e.g., a medium copy plasmid). In other embodiments, the therapeutic polypeptide of interest is expressed from a construct which is integrated into the bacterial chromosome, e.g., at one or more of the integration sites shown in FIG. 47. In certain embodiments, the genetically engineered bacteria comprise deletions or mutations in one or more of the outer membrane and/or periplasmic proteins. Non-limiting examples of such proteins, one or more of which may be deleted or mutated, include lpp, pal, tolA, and/or nlpI. In some embodiments, lpp is deleted or mutated. In some embodiments, pal is deleted or mutated. In some embodiments, tolA is deleted or mutated. In other embodiments, nlpI is deleted or mutated. In yet other embodiments, certain periplasmic proteases are deleted or mutated, e.g., to increase stability of the polypeptide in the periplasm. Non-limiting examples of such proteases include degP and ompT. In some embodiments, degP is deleted or mutated. In some embodiments, ompT is deleted or mutated. In some embodiments, degP and ompT are deleted or mutated.

In some embodiments, the therapeutic polypeptides of interest, e.g., GLP-2 peptides, GLP-2 analogs, IL-22, vIL-10, hIL-10, monomerized IL-10, IL-27, IL-19, IL-20, IL-24, are secreted via a Type V Auto-secreter (pic Protein) Secretion. In some embodiments, the therapeutic protein of interest is expressed as a fusion protein with the native Nissle auto-secreter E. coli 01635 (where the original passenger protein is replaced with the therapeutic polypeptides of interest.

In some embodiments, the therapeutic polypeptides of interest, e.g., GLP-2 peptides, GLP-2 analogs, IL-22, vIL-10, hIL-10, monomerized IL-10, IL-27, IL-19, IL-20, IL-24, are secreted via Type I Hemolysin Secretion. In one embodiment, therapeutic polypeptide of interest is expressed as fusion protein with the 53 amino acids of the C terminus of alpha-hemolysin (hlyA) of E. coli CFT073.

Essential Genes and Auxotrophs

As used herein, the term "essential gene" refers to a gene which is necessary to for cell growth and/or survival. Bacterial essential genes are well known to one of ordinary skill in the art, and can be identified by directed deletion of genes and/or random mutagenesis and screening (see, e.g., Zhang and Lin, 2009, DEG 5.0, a database of essential genes in both prokaryotes and eukaryotes, Nucl. Acids Res., 37:D455-D458 and Gerdes et al., Essential genes on metabolic maps, Curr. Opin. Biotechnol., 17(5):448-456, the entire contents of each of which are expressly incorporated herein by reference).

An "essential gene" may be dependent on the circumstances and environment in which an organism lives. For example, a mutation of, modification of, or excision of an essential gene may result in the genetically engineered bacteria of the disclosure becoming an auxotroph. An auxotrophic modification is intended to cause bacteria to die in the absence of an exogenously added nutrient essential for survival or growth because they lack the gene(s) necessary to produce that essential nutrient.

An auxotrophic modification is intended to cause bacteria to die in the absence of an exogenously added nutrient essential for survival or growth because they lack the gene(s) necessary to produce that essential nutrient. In some embodiments, any of the genetically engineered bacteria described herein also comprise a deletion or mutation in a gene required for cell survival and/or growth. In one embodiment, the essential gene is a DNA synthesis gene, for example, thyA. In another embodiment, the essential gene is a cell wall synthesis gene, for example, dapA. In yet another embodiment, the essential gene is an amino acid gene, for example, serA or MetA. Any gene required for cell survival and/or growth may be targeted, including but not limited to, cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thi1, as long as the corresponding wild-type gene product is not produced in the bacteria.

Table 33 lists depicts exemplary bacterial genes which may be disrupted or deleted to produce an auxotrophic strain. These include, but are not limited to, genes required for oligonucleotide synthesis, amino acid synthesis, and cell wall synthesis.

TABLE 33

Non-limiting Examples of Bacterial Genes Useful for Generation of an Auxotroph

| Amino Acid | Oligonucleotide | Cell Wall |
|---|---|---|
| cysE | thyA | dapA |
| glnA | uraA | dapB |
| ilvD | | dapD |
| leuB | | dapE |
| lysA | | dapF |
| serA | | |
| metA | | |
| glyA | | |
| hisB | | |
| ilvA | | |
| pheA | | |
| proA | | |
| thrC | | |
| trpC | | |
| tyrA | | |

Table 34 shows the survival of various amino acid auxotrophs in the mouse gut, as detected 24 hrs and 48 hrs post-gavage. These auxotrophs were generated using BW25113, a non-Nissle strain of E. coli.

TABLE 34

Survival of amino acid auxotrophs in the mouse gut

| Gene | AA Auxotroph | Pre-Gavage | 24 hours | 48 hours |
|---|---|---|---|---|
| argA | Arginine | Present | Present | Absent |
| cysE | Cysteine | Present | Present | Absent |
| glnA | Glutamine | Present | Present | Absent |
| glyA | Glycine | Present | Present | Absent |
| hisB | Histidine | Present | Present | Present |
| ilvA | Isoleucine | Present | Present | Absent |
| leuB | Leucine | Present | Present | Absent |
| lysA | Lysine | Present | Present | Absent |
| metA | Methionine | Present | Present | Present |
| pheA | Phenylalanine | Present | Present | Present |
| proA | Proline | Present | Present | Absent |
| serA | Serine | Present | Present | Present |
| thrC | Threonine | Present | Present | Present |
| trpC | Tryptophan | Present | Present | Present |
| tyrA | Tyrosine | Present | Present | Present |
| ilvD | Valine/Isoleucine/Leucine | Present | Present | Absent |
| thyA | Thiamine | Present | Absent | Absent |
| uraA | Uracil | Present | Absent | Absent |
| flhD | FlhD | Present | Present | Present |

For example, thymine is a nucleic acid that is required for bacterial cell growth; in its absence, bacteria undergo cell death. The thyA gene encodes thimidylate synthetase, an enzyme that catalyzes the first step in thymine synthesis by converting dUMP to dTMP (Sat et al., 2003). In some embodiments, the bacterial cell of the disclosure is a thyA auxotroph in which the thyA gene is deleted and/or replaced with an unrelated gene. A thyA auxotroph can grow only when sufficient amounts of thymine are present, e.g., by adding thymine to growth media in vitro, or in the presence of high thymine levels found naturally in the human gut in vivo. In some embodiments, the bacterial cell of the disclosure is auxotrophic in a gene that is complemented when the bacterium is present in the mammalian gut. Without sufficient amounts of thymine, the thyA auxotroph dies. In some embodiments, the auxotrophic modification is used to ensure that the bacterial cell does not survive in the absence of the auxotrophic gene product (e.g., outside of the gut).

Diaminopimelic acid (DAP) is an amino acid synthetized within the lysine biosynthetic pathway and is required for bacterial cell wall growth (Meadow et al., 1959; Clarkson et al., 1971). In some embodiments, any of the genetically engineered bacteria described herein is a dapD auxotroph in which dapD is deleted and/or replaced with an unrelated gene. A dapD auxotroph can grow only when sufficient amounts of DAP are present, e.g., by adding DAP to growth media in vitro. Without sufficient amounts of DAP, the dapD auxotroph dies. In some embodiments, the auxotrophic modification is used to ensure that the bacterial cell does not survive in the absence of the auxotrophic gene product (e.g., outside of the gut).

In other embodiments, the genetically engineered bacterium of the present disclosure is a uraA auxotroph in which uraA is deleted and/or replaced with an unrelated gene. The uraA gene codes for UraA, a membrane-bound transporter that facilitates the uptake and subsequent metabolism of the pyrimidine uracil (Andersen et al., 1995). A uraA auxotroph can grow only when sufficient amounts of uracil are present, e.g., by adding uracil to growth media in vitro. Without sufficient amounts of uracil, the uraA auxotroph dies. In some embodiments, auxotrophic modifications are used to ensure that the bacteria do not survive in the absence of the auxotrophic gene product (e.g., outside of the gut).

In complex communities, it is possible for bacteria to share DNA. In very rare circumstances, an auxotrophic bacterial strain may receive DNA from a non-auxotrophic strain, which repairs the genomic deletion and permanently rescues the auxotroph. Therefore, engineering a bacterial strain with more than one auxotroph may greatly decrease the probability that DNA transfer will occur enough times to rescue the auxotrophy. In some embodiments, the genetically engineered bacteria of the invention comprise a deletion or mutation in two or more genes required for cell survival and/or growth.

Other examples of essential genes include, but are not limited to yhbV, yagG, hemB, secD, secF, ribD, ribE, thiL, dxs, ispA, dnaX, adk, hemH, lpxH, cysS, fold, rplT, infC, thrS, nadE, gapA, yeaZ, aspS, argS, pgsA, yefM, metG, folE, yejM, gyrA, nrdA, nrdB, folC, accD, fabB, gltX, ligA, zipA, dapE, dapA, der, hisS, ispG, suhB, tadA, acpS, era, rnc, ftsB, eno, pyrG, chpR, lgt, fbaA, pgk, yqgD, metK, yqgF, plsC, ygiT, pare, ribB, cca, ygjD, tdcF, yraL, yihA, ftsN, murI, murB, birA, secE, nusG, rplJ, rplL, rpoB, rpoC, ubiA, plsB, lexA, dnaB, ssb, alsK, groS, psd, orn, yjeE, rpsR, chpS, ppa, valS, yjgP, yjgQ, dnaC, ribF, lspA, ispH, dapB, folA, imp, yabQ, ftsL, ftsI, murE, murF, mraY, murD, ftsW, murG, murC, ftsQ, ftsA, ftsZ, lpxC, secM, secA, can, folK, hemL, yadR, dapD, map, rpsB, infB, nusA, ftsH, obgE, rpmA, rplU, ispB, murA, yrbB, yrbK, yhbN, rpsI, rplM, degS, mreD, mreC, mreB, accB, accC, yrdC, def, fmt, rplQ, rpoA, rpsD, rpsK, rpsM, entD, mrdB, mrdA, nadD, hlepB, rpoE, pssA, yfiO, rplS, trmD, rpsP, ffh, grpE, yfjB, csrA, ispF, ispD, rplW, rplD, rplC, rpsJ, fusA, rpsG, rpsL, trpS, yrfF, asd, rpoH, ftsX, ftsE, ftsY, frr, dxr, ispU, rfaK, kdtA, coaD, rpmB, dfp, dut, gmk, spot, gyrB, dnaN, dnaA, rpmH, rnpA, yidC, tnaB, glmS, glmU, wzyE, hemD, hemC, yigP, ubiB, ubiD, hemG, secY, rplO, rpmD, rpsE, rplR, rplF, rpsH, rpsN, rplE, rplX, rplN, rpsQ, rpmC, rplP, rpsC, rplV, rpsS, rplB, cdsA, yaeL, yaeT, lpxD, fabZ, lpxA, lpxB, dnaE, accA, tilS, proS, yaff, tsf, pyrH, olA, rlpB, leuS, lnt, glnS, fldA, cydA, infA, cydC, ftsK, lolA, serS, rpsA, msbA, lpxK, kdsB, mukF, mukE, mukB, asnS, fabA, mviN, rne, yceQ, fabD, fabG, acpP, tmk, holB, lolC, lolD, lolE, purB, ymfK, minE, mind, pth, rsA, ispE, lolB, hemA, prfA, prmC, kdsA, topA, ribA, fabI, racR, dicA, ydfB, tyrS, ribC, ydiL, pheT, pheS, yhhQ, bcsB, glyQ, yibJ, and gpsA. Other essential genes are known to those of ordinary skill in the art.

In some embodiments, the genetically engineered bacterium of the present disclosure is a synthetic ligand-dependent essential gene (SLiDE) bacterial cell. SLiDE bacterial cells are synthetic auxotrophs with a mutation in one or more essential genes that only grow in the presence of a particular ligand (see Lopez and Anderson "Synthetic Auxotrophs with Ligand-Dependent Essential Genes for a BL21 (DE3) Biosafety Strain," ACS Synthetic Biology (2015) DOI: 10.1021/acssynbio.5b00085, the entire contents of which are expressly incorporated herein by reference).

In some embodiments, the SLiDE bacterial cell comprises a mutation in an essential gene. In some embodiments, the essential gene is selected from the group consisting of pheS, dnaN, tyrS, metG, and adk. In some embodiments, the essential gene is dnaN comprising one or more of the following mutations: H191N, R240C, I317S, F319V, L340T, V347I, and S345C. In some embodiments, the essential gene is dnaN comprising the mutations H191N, R240C, I317S, F319V, L340T, V347I, and S345C. In some embodiments, the essential gene is pheS comprising one or more of the following mutations: F125G, P183T, P184A, R186A, and I188L. In some embodiments, the essential gene is pheS comprising the mutations F125G, P183T, P184A, R186A, and I188L. In some embodiments, the essential gene is tyrS comprising one or more of the following mutations: L36V, C38A and F40G. In some embodiments, the essential gene is tyrS comprising the mutations L36V, C38A and F40G. In some embodiments, the essential gene is metG comprising one or more of the following mutations: E45Q, N47R, I49G, and A51C. In some embodiments, the essential gene is metG comprising the mutations E45Q, N47R, I49G, and A51C. In some embodiments, the essential gene is adk comprising one or more of the following mutations: I4L, L5I and L6G. In some embodiments, the essential gene is adk comprising the mutations I4L, L5I and L6G.

In some embodiments, the genetically engineered bacterium is complemented by a ligand. In some embodiments, the ligand is selected from the group consisting of benzothiazole, indole, 2-aminobenzothiazole, indole-3-butyric acid, indole-3-acetic acid, and L-histidine methyl ester. For example, bacterial cells comprising mutations in metG (E45Q, N47R, I49G, and A51C) are complemented by benzothiazole, indole, 2-aminobenzothiazole, indole-3-butyric acid, indole-3-acetic acid or L-histidine methyl ester. Bacterial cells comprising mutations in dnaN (H191N, R240C, I317S, F319V, L340T, V347I, and S345C) are complemented by benzothiazole, indole or 2-aminobenzothiazole. Bacterial cells comprising mutations in pheS (F125G, P183T, P184A, R186A, and I188L) are complemented by benzothiazole or 2-aminobenzothiazole. Bacterial cells comprising mutations in tyrS (L36V, C38A, and F40G) are complemented by benzothiazole or 2-aminobenzothiazole. Bacterial cells comprising mutations in adk (I4L, L5I and L6G) are complemented by benzothiazole or indole.

In some embodiments, the genetically engineered bacterium comprises more than one mutant essential gene that renders it auxotrophic to a ligand. In some embodiments, the bacterial cell comprises mutations in two essential genes. For example, in some embodiments, the bacterial cell comprises mutations in tyrS (L36V, C38A, and F40G) and metG (E45Q, N47R, I49G, and A51C). In other embodiments, the bacterial cell comprises mutations in three essential genes. For example, in some embodiments, the bacterial cell comprises mutations in tyrS (L36V, C38A, and F40G), metG (E45Q, N47R, I49G, and A51C), and pheS (F125G, P183T, P184A, R186A, and I188L).

Figure 56:
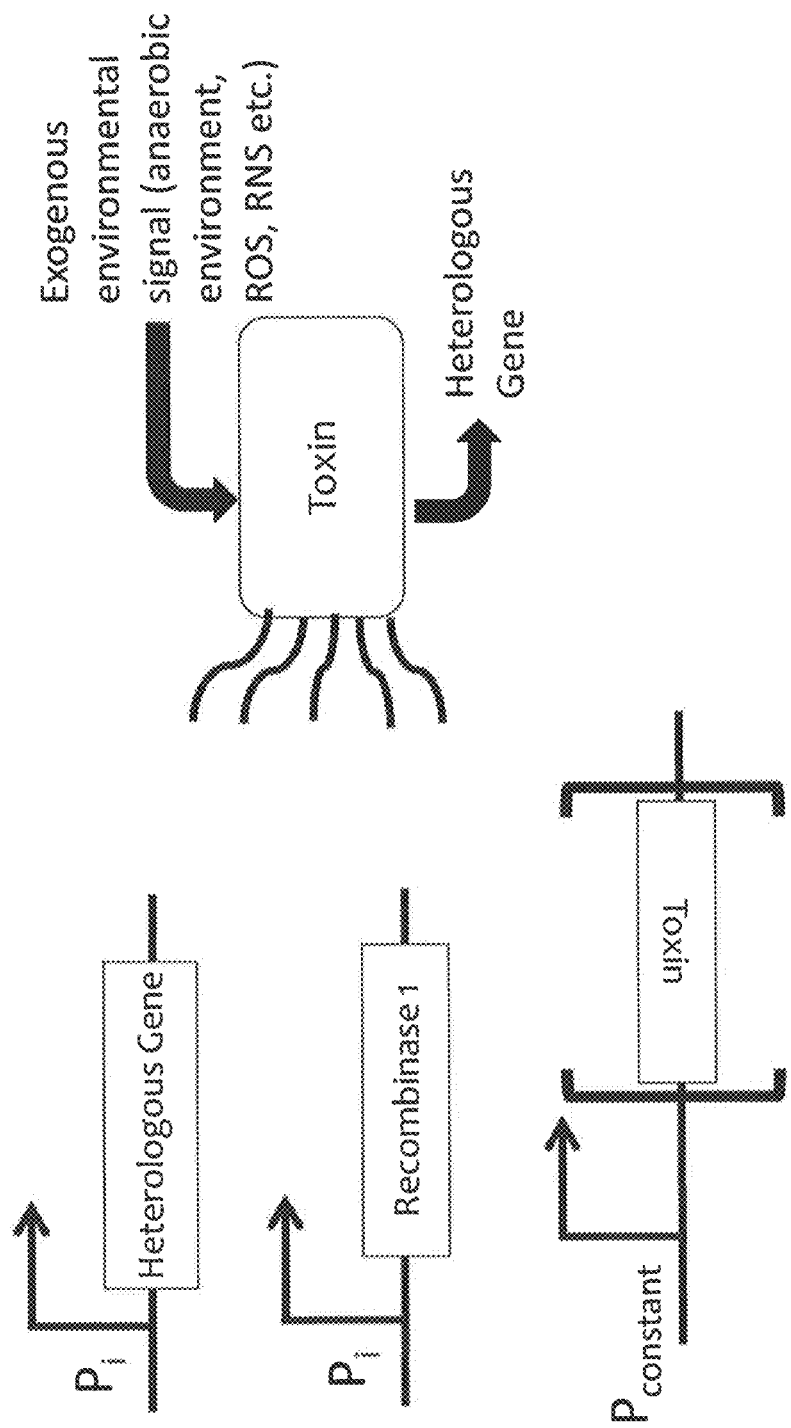
FIG. 56 depicts one non-limiting embodiment of the disclosure, where an exogenous environmental condition or one or more environmental signals activates expression of a heterologous gene and at least one recombinase from an inducible promoter or inducible promoters. The recombinase then flips a toxin gene into an activated conformation, and the natural kinetics of the recombinase create a time delay in expression of the toxin, allowing the heterologous gene to be fully expressed. Once the toxin is expressed, it kills the cell.

In some embodiments, the genetically engineered bacterium is a conditional auxotroph whose essential gene(s) is replaced using the arabinose system shown in FIG. 56.

In some embodiments, the genetically engineered bacterium of the disclosure is an auxotroph and also comprises kill-switch circuitry, such as any of the kill-switch components and systems described herein. For example, the genetically engineered bacteria may comprise a deletion or mutation in an essential gene required for cell survival and/or growth, for example, in a DNA synthesis gene, for example, thyA, cell wall synthesis gene, for example, dapA and/or an amino acid gene, for example, serA or MetA and may also comprise a toxin gene that is regulated by one or more transcriptional activators that are expressed in response to an environmental condition(s) and/or signal(s) (such as the described arabinose system) or regulated by one or more recombinases that are expressed upon sensing an exogenous environmental condition(s) and/or signal(s) (such as the recombinase systems described herein). Other embodiments are described in Wright et al., "GeneGuard: A Modular Plasmid System Designed for Biosafety," ACS Synthetic Biology (2015) 4: 307-16, the entire contents of which are expressly incorporated herein by reference). In some embodiments, the genetically engineered bacterium of the disclosure is an auxotroph and also comprises kill-switch circuitry, such as any of the kill-switch components and systems described herein, as well as another biosecurity system, such a conditional origin of replication (Wright et al., 2015). In other embodiments, auxotrophic modifications may also be used to screen for mutant bacteria that produce the anti-inflammatory or gut barrier enhancer molecule.

Genetic Regulatory Circuits

In some embodiments, the genetically engineered bacteria comprise multilayered genetic regulatory circuits for expressing the constructs described herein (see, e.g., U.S. Provisional Application No. 62/184,811 and PCT/US2016/39434, both of which are incorporated herein by reference in their entireties). The genetic regulatory circuits are useful to screen for mutant bacteria that produce an anti-inflammation and/or gut barrier enhancer molecule or rescue an auxotroph. In certain embodiments, the invention provides methods for selecting genetically engineered bacteria that produce one or more genes of interest.

In some embodiments, the invention provides genetically engineered bacteria comprising a gene or gene cassette for producing a therapeutic molecule (e.g., butyrate) and a T7 polymerase-regulated genetic regulatory circuit. For example, the genetically engineered bacteria comprise a first gene encoding a T7 polymerase, wherein the first gene is operably linked to a FNR-responsive promoter; a second gene or gene cassette for producing a therapeutic molecule (e.g., butyrate), wherein the second gene or gene cassette is operably linked to a T7 promoter that is induced by the T7 polymerase; and a third gene encoding an inhibitory factor, lysY, that is capable of inhibiting the T7 polymerase. In the presence of oxygen, FNR does not bind the FNR-responsive promoter, and the therapeutic molecule (e.g., butyrate) is not expressed. LysY is expressed constitutively (P-lac constitutive) and further inhibits T7 polymerase. In the absence of oxygen, FNR dimerizes and binds to the FNR-responsive promoter, T7 polymerase is expressed at a level sufficient to overcome lysY inhibition, and the therapeutic molecule (e.g., butyrate) is expressed. In some embodiments, the lysY gene is operably linked to an additional FNR binding site. In the absence of oxygen, FNR dimerizes to activate T7 polymerase expression as described above, and also inhibits lysY expression.

In some embodiments, the invention provides genetically engineered bacteria comprising a gene or gene cassette for producing a therapeutic molecule (e.g., butyrate) and a protease-regulated genetic regulatory circuit. For example, the genetically engineered bacteria comprise a first gene encoding an mf-lon protease, wherein the first gene is operably linked to a FNR-responsive promoter; a second gene or gene cassette for producing a therapeutic molecule operably linked to a Tet regulatory region (TetO); and a third gene encoding an mf-lon degradation signal linked to a Tet repressor (TetR), wherein the TetR is capable of binding to the Tet regulatory region and repressing expression of the second gene or gene cassette. The mf-lon protease is capable of recognizing the mf-lon degradation signal and degrading the TetR. In the presence of oxygen, FNR does not bind the FNR-responsive promoter, the repressor is not degraded, and the therapeutic molecule is not expressed. In the absence of oxygen, FNR dimerizes and binds the FNR-responsive promoter, thereby inducing expression of the mf-lon protease. The mf-lon protease recognizes the mf-lon degradation signal and degrades the TetR, and the therapeutic molecule is expressed.

In some embodiments, the invention provides genetically engineered bacteria comprising a gene or gene cassette for producing a therapeutic molecule and a repressor-regulated genetic regulatory circuit. For example, the genetically engineered bacteria comprise a first gene encoding a first repressor, wherein the first gene is operably linked to a FNR-responsive promoter; a second gene or gene cassette for producing a therapeutic molecule operably linked to a first regulatory region comprising a constitutive promoter; and a third gene encoding a second repressor, wherein the second repressor is capable of binding to the first regulatory region and repressing expression of the second gene or gene cassette. The third gene is operably linked to a second regulatory region comprising a constitutive promoter, wherein the first repressor is capable of binding to the second regulatory region and inhibiting expression of the second repressor. In the presence of oxygen, FNR does not bind the FNR-responsive promoter, the first repressor is not expressed, the second repressor is expressed, and the therapeutic molecule is not expressed. In the absence of oxygen, FNR dimerizes and binds the FNR-responsive promoter, the first repressor is expressed, the second repressor is not expressed, and the therapeutic molecule is expressed.

Examples of repressors useful in these embodiments include, but are not limited to, ArgR, TetR, ArsR, AscG, Lad, CscR, DeoR, DgoR, FruR, GalR, GatR, CI, LexA, RafR, QacR, and PtxS (US20030166191).

In some embodiments, the invention provides genetically engineered bacteria comprising a gene or gene cassette for producing a therapeutic molecule and a regulatory RNA-regulated genetic regulatory circuit. For example, the genetically engineered bacteria comprise a first gene encoding a regulatory RNA, wherein the first gene is operably linked to a FNR-responsive promoter, and a second gene or gene cassette for producing a therapeutic molecule. The second gene or gene cassette is operably linked to a constitutive promoter and further linked to a nucleotide sequence capable of producing an mRNA hairpin that inhibits translation of the therapeutic molecule. The regulatory RNA is capable of eliminating the mRNA hairpin and inducing translation via the ribosomal binding site. In the presence of oxygen, FNR does not bind the FNR-responsive promoter, the regulatory RNA is not expressed, and the mRNA hairpin prevents the therapeutic molecule from being translated. In the absence of oxygen, FNR dimerizes and binds the FNR-responsive promoter, the regulatory RNA is expressed, the mRNA hairpin is eliminated, and the therapeutic molecule is expressed.

In some embodiments, the invention provides genetically engineered bacteria comprising a gene or gene cassette for producing a therapeutic molecule and a CRISPR-regulated genetic regulatory circuit. For example, the genetically engineered bacteria comprise a Cas9 protein; a first gene encoding a CRISPR guide RNA, wherein the first gene is operably linked to a FNR-responsive promoter; a second gene or gene cassette for producing a therapeutic molecule, wherein the second gene or gene cassette is operably linked to a regulatory region comprising a constitutive promoter; and a third gene encoding a repressor operably linked to a constitutive promoter, wherein the repressor is capable of binding to the regulatory region and repressing expression of the second gene or gene cassette. The third gene is further linked to a CRISPR target sequence that is capable of binding to the CRISPR guide RNA, wherein said binding to the CRISPR guide RNA induces cleavage by the Cas9 protein and inhibits expression of the repressor. In the presence of oxygen, FNR does not bind the FNR-responsive promoter, the guide RNA is not expressed, the repressor is expressed, and the therapeutic molecule is not expressed. In the absence of oxygen, FNR dimerizes and binds the FNR-responsive promoter, the guide RNA is expressed, the repressor is not expressed, and the therapeutic molecule is expressed.

In some embodiments, the invention provides genetically engineered bacteria comprising a gene or gene cassette for producing a therapeutic molecule and a recombinase-regulated genetic regulatory circuit. For example, the genetically engineered bacteria comprise a first gene encoding a recombinase, wherein the first gene is operably linked to a FNR-responsive promoter, and a second gene or gene cassette for producing a therapeutic molecule operably linked to a constitutive promoter. The second gene or gene cassette is inverted in orientation (3' to 5') and flanked by recombinase binding sites, and the recombinase is capable of binding to the recombinase binding sites to induce expression of the second gene or gene cassette by reverting its orientation (5' to 3'). In the presence of oxygen, FNR does not bind the FNR-responsive promoter, the recombinase is not expressed, the gene or gene cassette remains in the 3' to 5' orientation, and no functional therapeutic molecule is produced. In the absence of oxygen, FNR dimerizes and binds the FNR-responsive promoter, the recombinase is expressed, the gene or gene cassette is reverted to the 5' to 3' orientation, and a functional therapeutic molecule is produced.

In some embodiments, the invention provides genetically engineered bacteria comprising a gene or gene cassette for producing a therapeutic molecule and a polymerase- and recombinase-regulated genetic regulatory circuit. For example, the genetically engineered bacteria comprise a first gene encoding a recombinase, wherein the first gene is operably linked to a FNR-responsive promoter; a second gene or gene cassette for producing a therapeutic molecule operably linked to a T7 promoter; a third gene encoding a T7 polymerase, wherein the T7 polymerase is capable of binding to the T7 promoter and inducing expression of the therapeutic molecule. The third gene encoding the T7 polymerase is inverted in orientation (3' to 5') and flanked by recombinase binding sites, and the recombinase is capable of binding to the recombinase binding sites to induce expression of the T7 polymerase gene by reverting its orientation (5' to 3'). In the presence of oxygen, FNR does not bind the FNR-responsive promoter, the recombinase is not expressed, the T7 polymerase gene remains in the 3' to 5' orientation, and the therapeutic molecule is not expressed. In the absence of oxygen, FNR dimerizes and binds the FNR-responsive promoter, the recombinase is expressed, the T7 polymerase gene is reverted to the 5' to 3' orientation, and the therapeutic molecule is expressed.

Synthetic gene circuits expressed on plasmids may function well in the short term but lose ability and/or function in the long term (Danino et al., 2015). In some embodiments, the genetically engineered bacteria comprise stable circuits for expressing genes of interest over prolonged periods. In some embodiments, the genetically engineered bacteria are capable of producing a therapeutic molecule and further comprise a toxin-anti-toxin system that simultaneously produces a toxin (hok) and a short-lived anti-toxin (sok), wherein loss of the plasmid causes the cell to be killed by the long-lived toxin (Danino et al., 2015). In some embodiments, the genetically engineered bacteria further comprise alp7 from *B. subtilis* plasmid pL20 and produces filaments that are capable of pushing plasmids to the poles of the cells in order to ensure equal segregation during cell division (Danino et al., 2015).

Host-Plasmid Mutual Dependency

In some embodiments, the genetically engineered bacteria of the invention also comprise a plasmid that has been modified to create a host-plasmid mutual dependency. In certain embodiments, the mutually dependent host-plasmid platform is GeneGuard (Wright et al., 2015). In some embodiments, the GeneGuard plasmid comprises (i) a conditional origin of replication, in which the requisite replication initiator protein is provided in trans; (ii) an auxotrophic modification that is rescued by the host via genomic translocation and is also compatible for use in rich media; and/or (iii) a nucleic acid sequence which encodes a broad-spectrum toxin. The toxin gene may be used to select against plasmid spread by making the plasmid DNA itself disadvantageous for strains not expressing the anti-toxin (e.g., a wild-type bacterium). In some embodiments, the GeneGuard plasmid is stable for at least 100 generations without antibiotic selection. In some embodiments, the GeneGuard plasmid does not disrupt growth of the host. The GeneGuard plasmid is used to greatly reduce unintentional plasmid propagation in the genetically engineered bacteria of the invention.

The mutually dependent host-plasmid platform may be used alone or in combination with other biosafety mechanisms, such as those described herein (e.g., kill switches, auxotrophies). In some embodiments, the genetically engineered bacteria comprise a GeneGuard plasmid. In other embodiments, the genetically engineered bacteria comprise a GeneGuard plasmid and/or one or more kill switches. In other embodiments, the genetically engineered bacteria comprise a GeneGuard plasmid and/or one or more auxotrophies. In still other embodiments, the genetically engineered bacteria comprise a GeneGuard plasmid, one or more kill switches, and/or one or more auxotrophies.

Synthetic gene circuits express on plasmids may function well in the short term but lose ability and/or function in the long term (Danino et al., 2015). In some embodiments, the genetically engineered bacteria comprise stable circuits for expressing genes of interest over prolonged periods. In some embodiments, the genetically engineered bacteria are capable of producing an anti-inflammation and/or gut enhancer molecule and further comprise a toxin-anti-toxin system that simultaneously produces a toxin (hok) and a short-lived anti-toxin (sok), wherein loss of the plasmid causes the cell to be killed by the long-lived toxin (Danino et al., 2015; FIG. 66). In some embodiments, the genetically engineered bacteria further comprise alp7 from *B. subtilis* plasmid pL20 and produces filaments that are capable of pushing plasmids to the poles of the cells in order to ensure equal segregation during cell division (Danino et al., 2015).

Kill Switch

In some embodiments, the genetically engineered bacteria of the invention also comprise a kill switch (see, e.g., U.S. Provisional Application Nos. 62/183,935, 62/263,329, and 62/277,654, each of which is incorporated herein by reference in their entireties). The kill switch is intended to actively kill genetically engineered bacteria in response to external stimuli. As opposed to an auxotrophic mutation where bacteria die because they lack an essential nutrient for survival, the kill switch is triggered by a particular factor in the environment that induces the production of toxic molecules within the microbe that cause cell death.

Bacteria comprising kill switches have been engineered for in vitro research purposes, e.g., to limit the spread of a biofuel-producing microorganism outside of a laboratory environment. Bacteria engineered for in vivo administration to treat a disease may also be programmed to die at a specific time after the expression and delivery of a heterologous gene or genes, for example, an anti-inflammation and/or gut barrier enhancer molecule, or after the subject has experienced the therapeutic effect. For example, in some embodiments, the kill switch is activated to kill the bacteria after a period of time following expression of the anti-inflammation and/or gut barrier enhancer molecule, e.g., GLP-2. In some embodiments, the kill switch is activated in a delayed fashion following expression of the anti-inflammation and/or gut barrier enhancer molecule. Alternatively, the bacteria may be engineered to die after the bacterium has spread outside of a disease site. Specifically, it may be useful to prevent long-term colonization of subjects by the microorganism, spread of the microorganism outside the area of interest (for example, outside the gut) within the subject, or spread of the microorganism outside of the subject into the environment (for example, spread to the environment through the stool of the subject). Examples of such toxins that can be used in kill-switches include, but are not limited to, bacteriocins, lysins, and other molecules that cause cell death by lysing cell membranes, degrading cellular DNA, or other mechanisms. Such toxins can be used individually or in combination. The switches that control their production can be based on, for example, transcriptional activation (toggle switches; see, e.g., Gardner et al., 2000), translation (riboregulators), or DNA recombination (recombinase-based switches), and can sense environmental stimuli such as anaerobiosis or reactive oxygen species. These switches can be activated by a single environmental factor or may require several activators in AND, OR, NAND and NOR logic configurations to induce cell death. For example, an AND riboregulator switch is activated by tetracycline, isopropyl β-D-1-thiogalactopyranoside (IPTG), and arabinose to induce the expression of lysins, which permeabilize the cell membrane and kill the cell. IPTG induces the expression of the endolysin and holin mRNAs, which are then derepressed by the addition of arabinose and tetracycline. All three inducers must be present to cause cell death. Examples of kill switches are known in the art (Callura et al., 2010).

Kill-switches can be designed such that a toxin is produced in response to an environmental condition or external signal (e.g., the bacteria is killed in response to an external cue) or, alternatively designed such that a toxin is produced once an environmental condition no longer exists or an external signal is ceased.

Thus, in some embodiments, the genetically engineered bacteria of the disclosure are further programmed to die after sensing an exogenous environmental signal, for example, in low-oxygen conditions, in the presence of ROS, or in the presence of RNS. In some embodiments, the genetically engineered bacteria of the present disclosure comprise one or more genes encoding one or more recombinase(s), whose expression is induced in response to an environmental condition or signal and causes one or more recombination events that ultimately leads to the expression of a toxin which kills the cell. In some embodiments, the at least one recombination event is the flipping of an inverted heterologous gene encoding a bacterial toxin which is then constitutively expressed after it is flipped by the first recombinase. In one embodiment, constitutive expression of the bacterial toxin kills the genetically engineered bacterium. In these types of kill-switch systems once the engineered bacterial cell senses the exogenous environmental condition and expresses the heterologous gene of interest, the recombinant bacterial cell is no longer viable.

In another embodiment in which the genetically engineered bacteria of the present disclosure express one or more recombinase(s) in response to an environmental condition or signal causing at least one recombination event, the genetically engineered bacterium further expresses a heterologous gene encoding an anti-toxin in response to an exogenous environmental condition or signal. In one embodiment, the at least one recombination event is flipping of an inverted heterologous gene encoding a bacterial toxin by a first recombinase. In one embodiment, the inverted heterologous gene encoding the bacterial toxin is located between a first forward recombinase recognition sequence and a first reverse recombinase recognition sequence. In one embodiment, the heterologous gene encoding the bacterial toxin is constitutively expressed after it is flipped by the first recombinase. In one embodiment, the anti-toxin inhibits the activity of the toxin, thereby delaying death of the genetically engineered bacterium. In one embodiment, the genetically engineered bacterium is killed by the bacterial toxin when the heterologous gene encoding the anti-toxin is no longer expressed when the exogenous environmental condition is no longer present.

In another embodiment, the at least one recombination event is flipping of an inverted heterologous gene encoding a second recombinase by a first recombinase, followed by the flipping of an inverted heterologous gene encoding a bacterial toxin by the second recombinase. In one embodiment, the inverted heterologous gene encoding the second recombinase is located between a first forward recombinase recognition sequence and a first reverse recombinase recognition sequence. In one embodiment, the inverted heterologous gene encoding the bacterial toxin is located between a second forward recombinase recognition sequence and a second reverse recombinase recognition sequence. In one embodiment, the heterologous gene encoding the second recombinase is constitutively expressed after it is flipped by the first recombinase. In one embodiment, the heterologous gene encoding the bacterial toxin is constitutively expressed after it is flipped by the second recombinase. In one embodiment, the genetically engineered bacterium is killed by the bacterial toxin. In one embodiment, the genetically engineered bacterium further expresses a heterologous gene encoding an anti-toxin in response to the exogenous environmental condition. In one embodiment, the anti-toxin inhibits the activity of the toxin when the exogenous environmental condition is present, thereby delaying death of the genetically engineered bacterium. In one embodiment, the genetically engineered bacterium is killed by the bacterial toxin when the heterologous gene encoding the anti-toxin is no longer expressed when the exogenous environmental condition is no longer present.

In one embodiment, the at least one recombination event is flipping of an inverted heterologous gene encoding a second recombinase by a first recombinase, followed by flipping of an inverted heterologous gene encoding a third recombinase by the second recombinase, followed by flipping of an inverted heterologous gene encoding a bacterial toxin by the third recombinase.

In one embodiment, the at least one recombination event is flipping of an inverted heterologous gene encoding a first excision enzyme by a first recombinase. In one embodiment, the inverted heterologous gene encoding the first excision enzyme is located between a first forward recombinase recognition sequence and a first reverse recombinase recognition sequence. In one embodiment, the heterologous gene encoding the first excision enzyme is constitutively expressed after it is flipped by the first recombinase. In one embodiment, the first excision enzyme excises a first essential gene. In one embodiment, the programmed recombinant bacterial cell is not viable after the first essential gene is excised.

In one embodiment, the first recombinase further flips an inverted heterologous gene encoding a second excision enzyme. In one embodiment, the inverted heterologous gene encoding the second excision enzyme is located between a second forward recombinase recognition sequence and a second reverse recombinase recognition sequence. In one embodiment, the heterologous gene encoding the second excision enzyme is constitutively expressed after it is flipped by the first recombinase. In one embodiment, the genetically engineered bacterium dies or is no longer viable when the first essential gene and the second essential gene are both excised. In one embodiment, the genetically engineered bacterium dies or is no longer viable when either the first essential gene is excised or the second essential gene is excised by the first recombinase.

In one embodiment, the genetically engineered bacterium dies after the at least one recombination event occurs. In another embodiment, the genetically engineered bacterium is no longer viable after the at least one recombination event occurs.

In any of these embodiment, the recombinase can be a recombinase selected from the group consisting of: BxbI, PhiC31, TP901, BxbI, PhiC31, TP901, HK022, HP1, R4, Int1, Int2, Int3, Int4, IntS, Int6, Int1, Int8, Int9, Int10, Int11, Int12, Int13, Int14, Int15, Int16, Int17, Int18, Int19, Int20, Int21, Int22, Int23, Int24, Int25, Int26, Int27, Int28, Int29, Int30, Int31, Int32, Int33, and Int34, or a biologically active fragment thereof.

Figure 57:
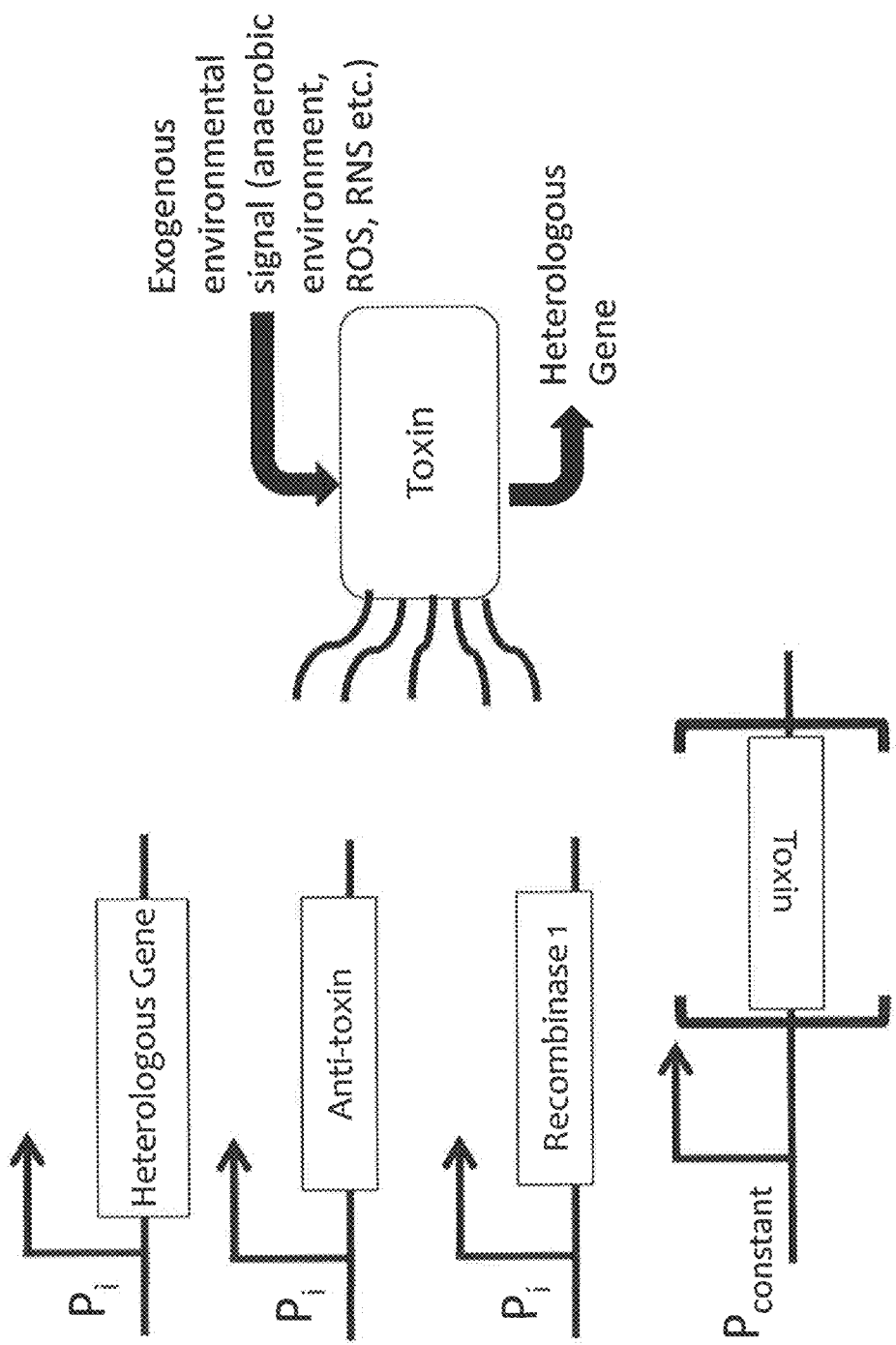
FIG. 57 depicts another non-limiting embodiment of the disclosure, where an exogenous environmental condition or one or more environmental signals activates expression of a heterologous gene, an anti-toxin, and at least one recombinase from an inducible promoter or inducible promoters. The recombinase then flips a toxin gene into an activated conformation, but the presence of the accumulated anti-toxin suppresses the activity of the toxin. Once the exogenous environmental condition or cue(s) is no longer present, expression of the anti-toxin is turned off. The toxin is constitutively expressed, continues to accumulate, and kills the bacterial cell.
Figure 58:
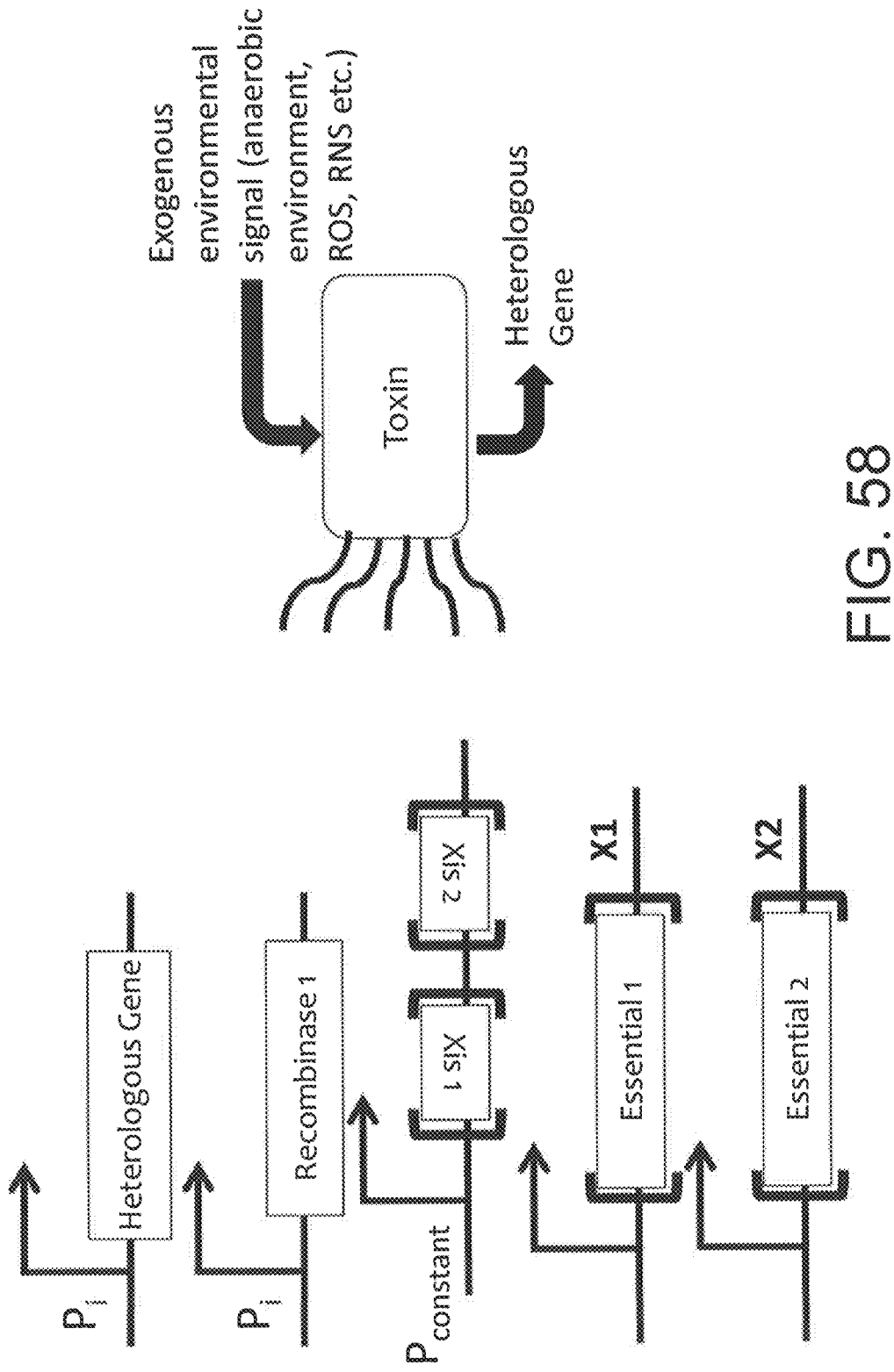
FIG. 58 depicts another non-limiting embodiment of the disclosure, where an exogenous environmental condition or one or more environmental signals activates expression of a heterologous gene and at least one recombinase from an inducible promoter or inducible promoters. The recombinase then flips at least one excision enzyme into an activated conformation. The at least one excision enzyme then excises one or more essential genes, leading to senescence, and eventual cell death. The natural kinetics of the recombinase and excision genes cause a time delay, the kinetics of which can be altered and optimized depending on the number and choice of essential genes to be excised, allowing cell death to occur within a matter of hours or days. The presence of multiple nested recombinases can be used to further control the timing of cell death.
Figure 59:
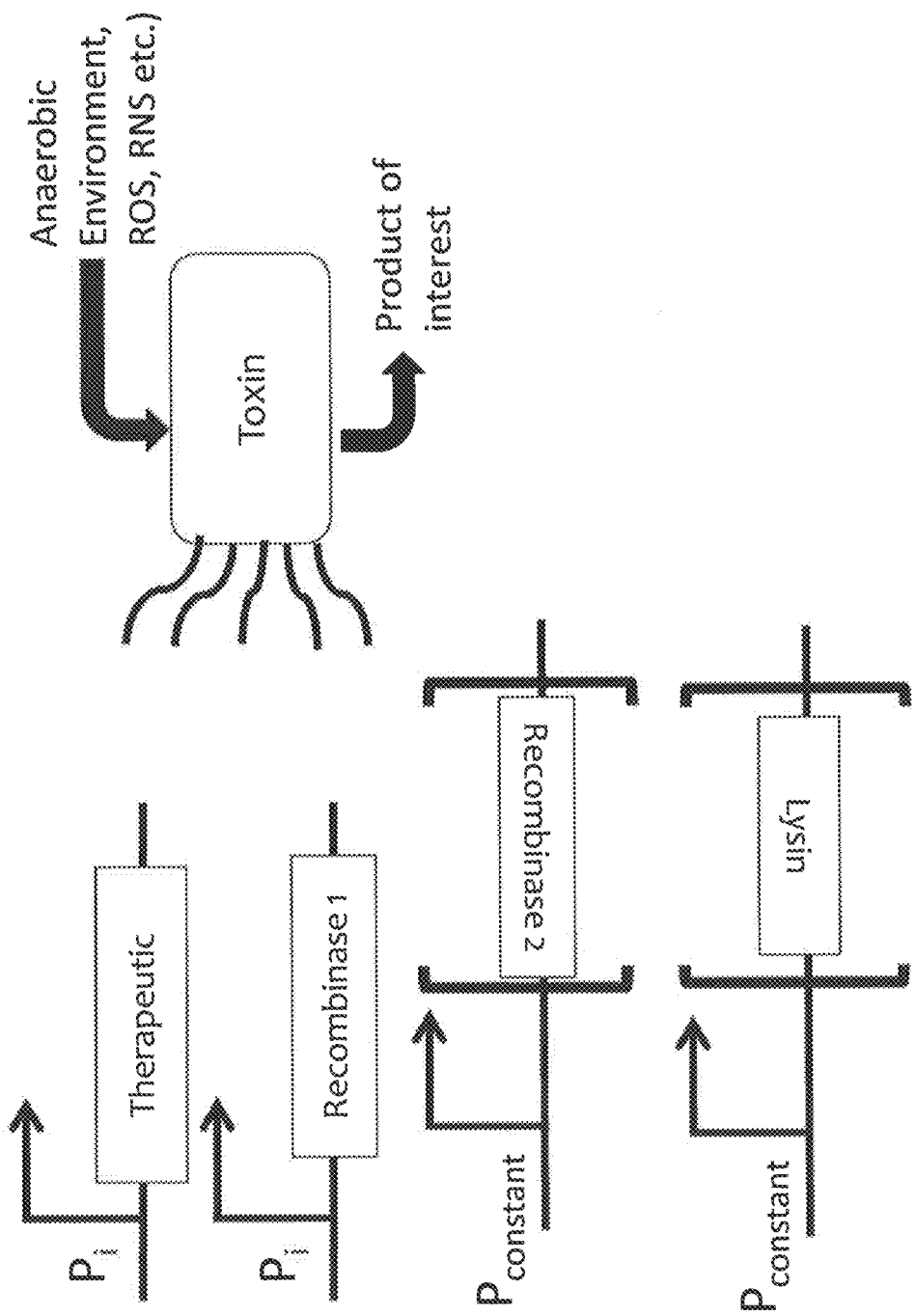
FIG. 59 depicts one non-limiting embodiment of the disclosure, where an exogenous environmental condition or one or more environmental signals activates expression of a heterologous gene and a first recombinase from an inducible promoter or inducible promoters. The recombinase then flips a second recombinase from an inverted orientation to an active conformation. The activated second recombinase flips the toxin gene into an activated conformation, and the natural kinetics of the recombinase create a time delay in expression of the toxin, allowing the heterologous gene to be fully expressed. Once the toxin is expressed, it kills the cell.
Figure 60:
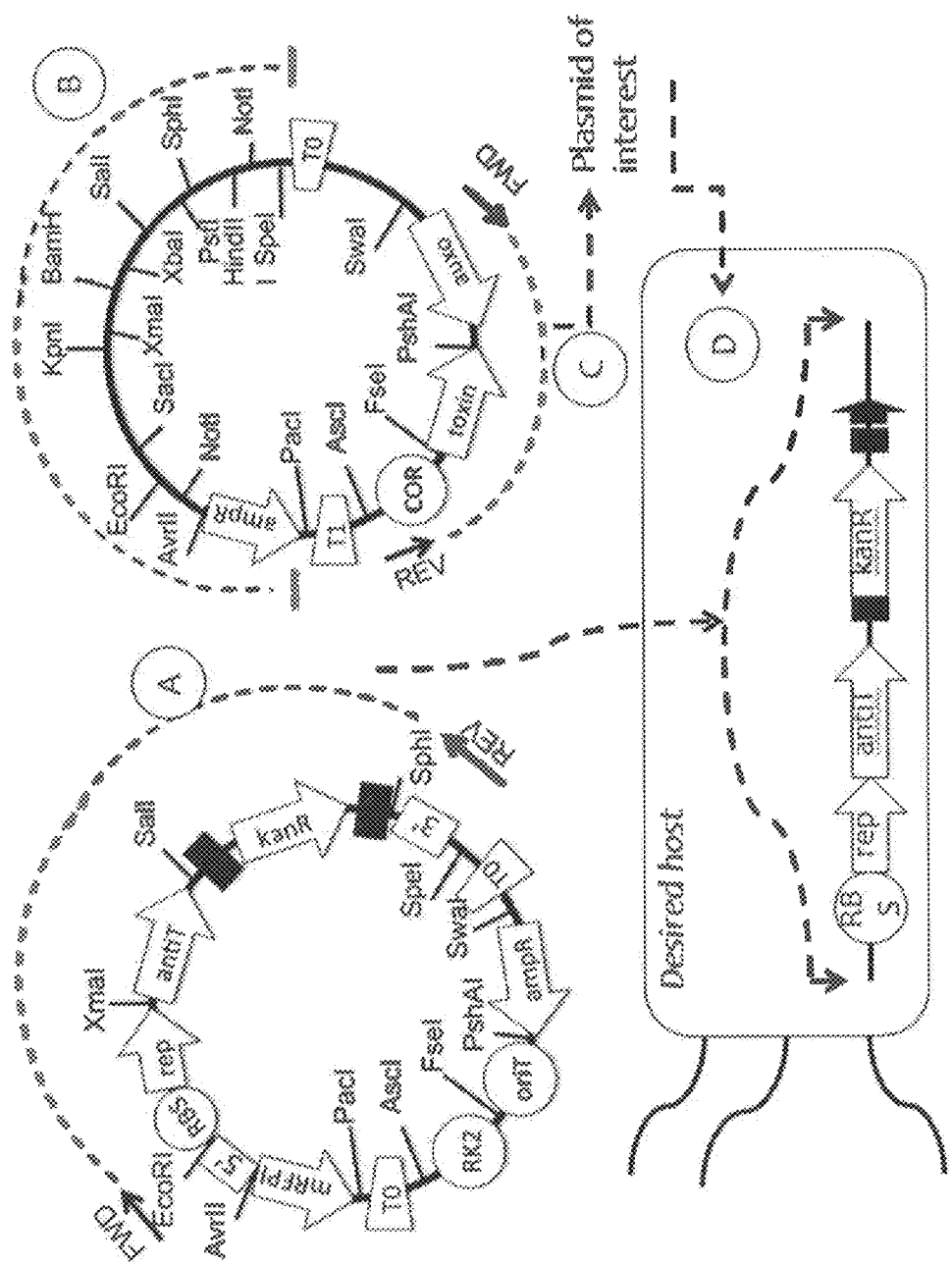
FIG. 60 depicts the use of GeneGuards as an engineered safety component. All engineered DNA is present on a plasmid which can be conditionally destroyed. See, e.g., Wright et al., "GeneGuard: A Modular Plasmid System Designed for Biosafety," ACS Synthetic Biology (2015) 4: 307-316.
Figure 61:
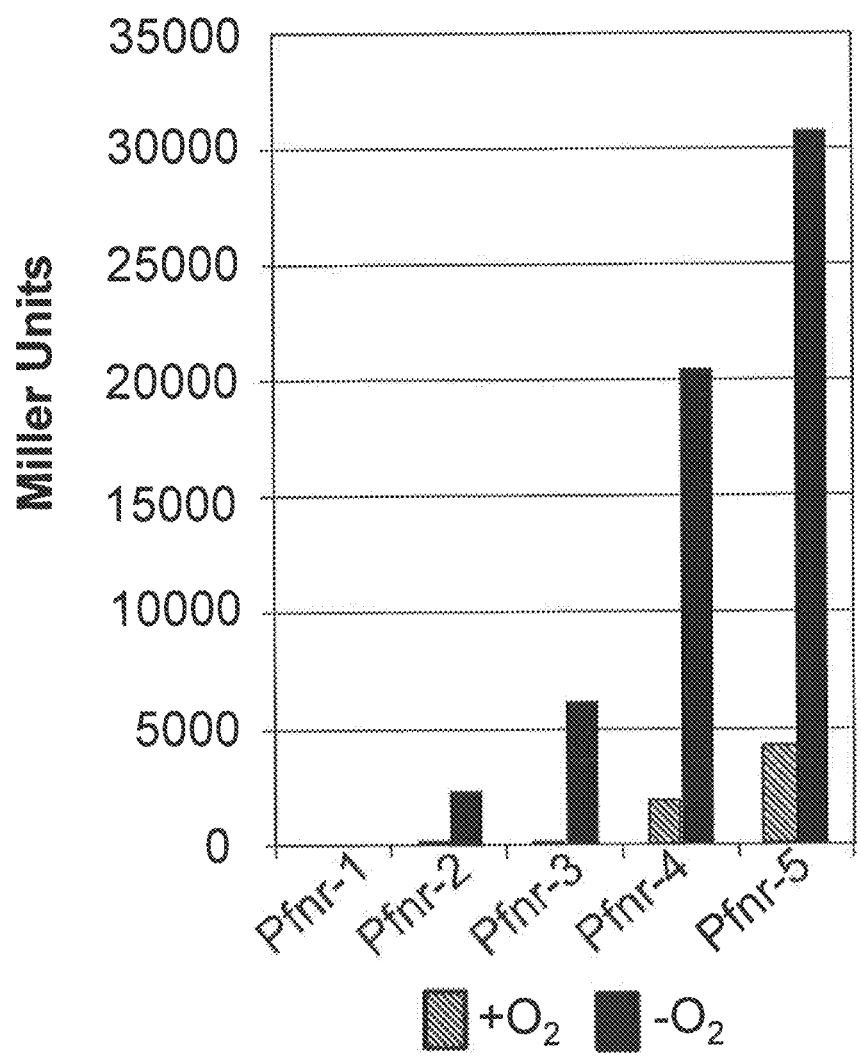
FIG. 61 depicts β-galactosidase levels in samples comprising bacteria harboring a low-copy plasmid expressing lacZ from an FNR-responsive promoter selected from the exemplary FNR promoters shown in Table 25 (Pfnr1-5). Different FNR-responsive promoters were used to create a library of anaerobic-inducible reporters with a variety of expression levels and dynamic ranges. These promoters included strong ribosome binding sites. Bacterial cultures were grown in either aerobic ($+O_2$) or anaerobic conditions ($-O_2$). Samples were removed at 4 hrs and the promoter activity based on β-galactosidase levels was analyzed by performing standard β-galactosidase colorimetric assays.
Figure 62A:
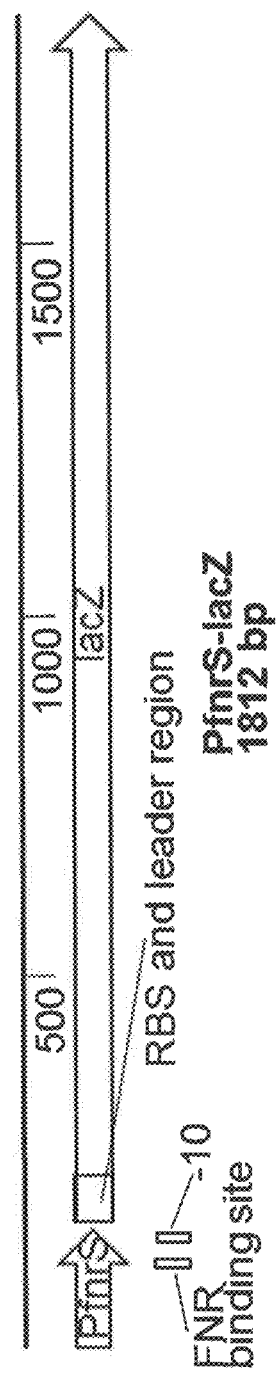
FIGS. 62A-62C depict a schematic representation of the lacZ gene under the control of an exemplary FNR promoter ($P_{fnrS}$) and corresponding graphical data.
Figure 62B:
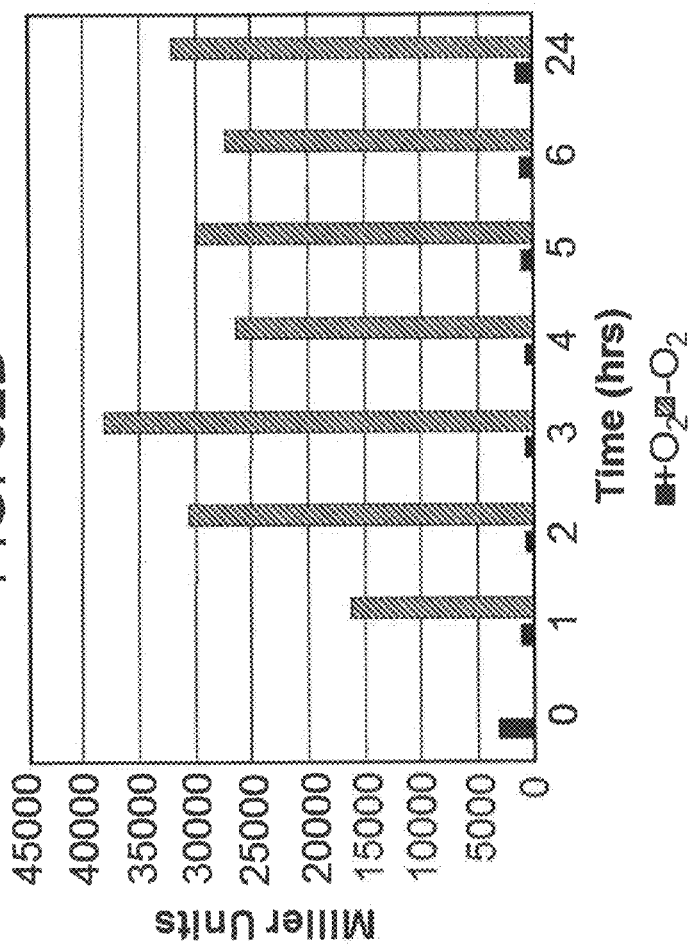
Figure 62C:
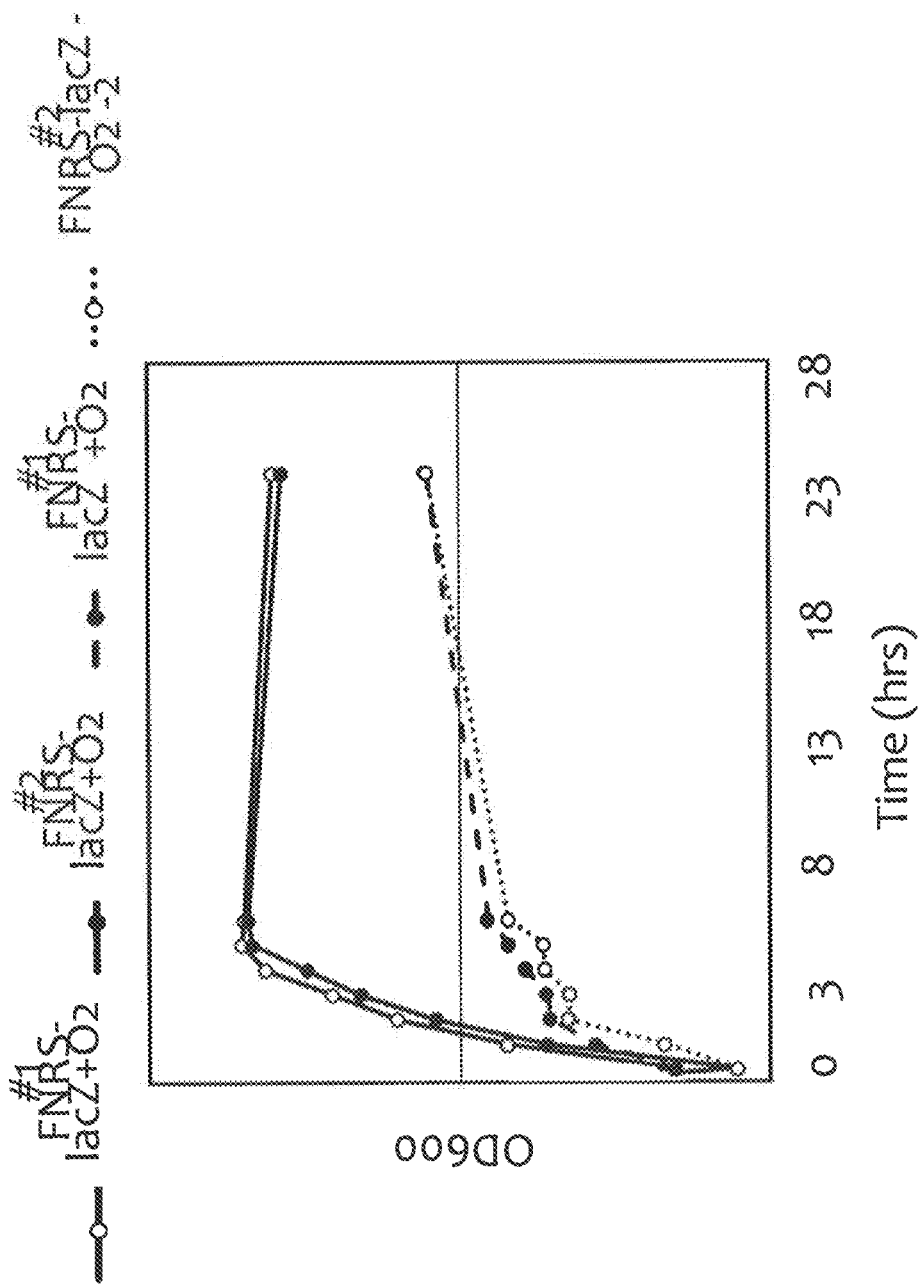
Figure 65:
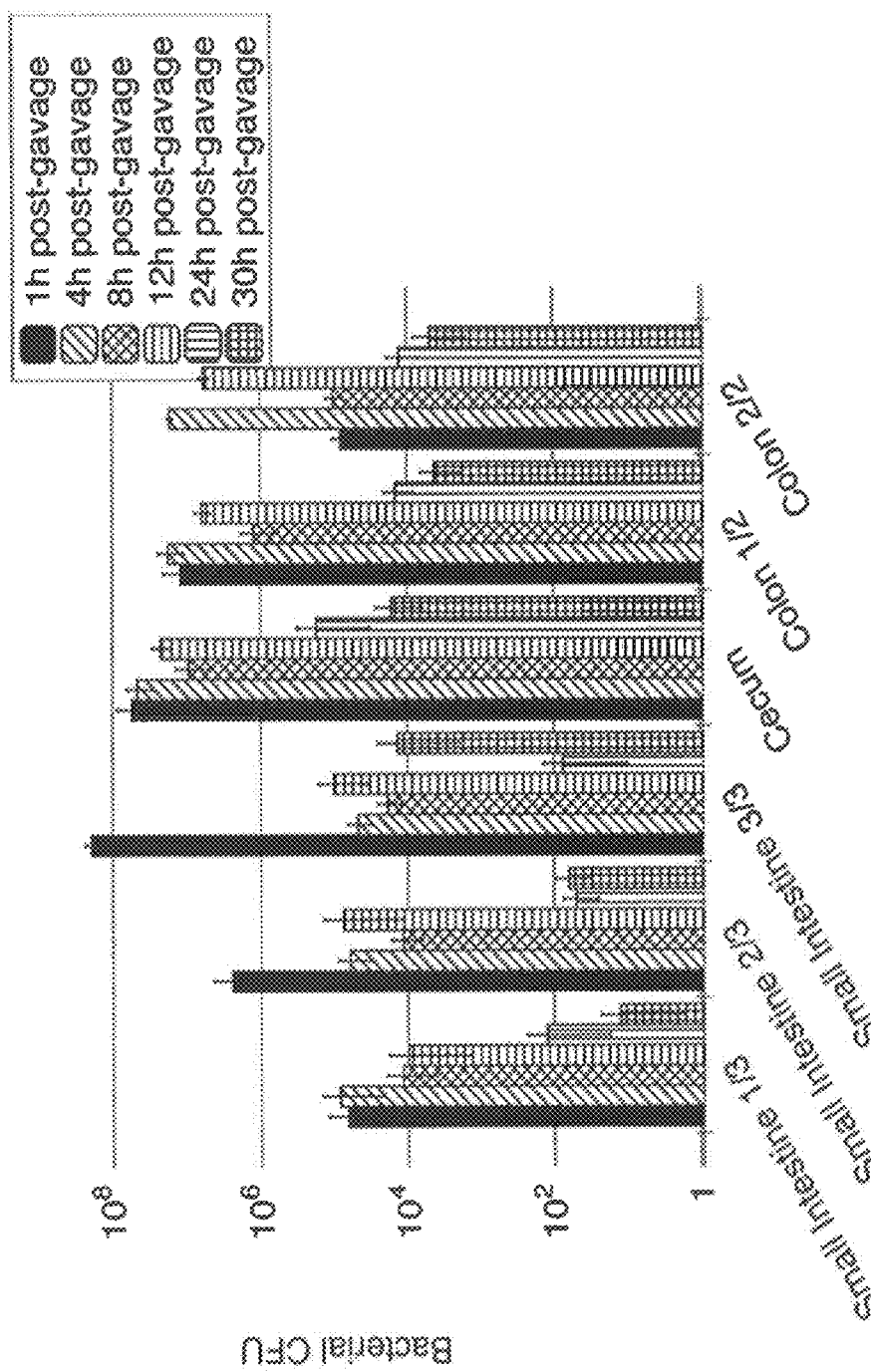
FIG. 65 depicts a bar graph of residence over time for streptomycin resistant Nissle in various compartments of the intestinal tract at 1, 4, 8, 12, 24, and 30 hours post gavage. Mice were treated with approximately 109 CFU, and at each timepoint, animals (n=4) were euthanized, and intestine, cecum, and colon were removed. The small intestine was cut into three sections, and the large intestine and colon each into two sections. Intestinal effluents gathered and CFUs in each compartment were determined by serial dilution plating.
Figure 67:
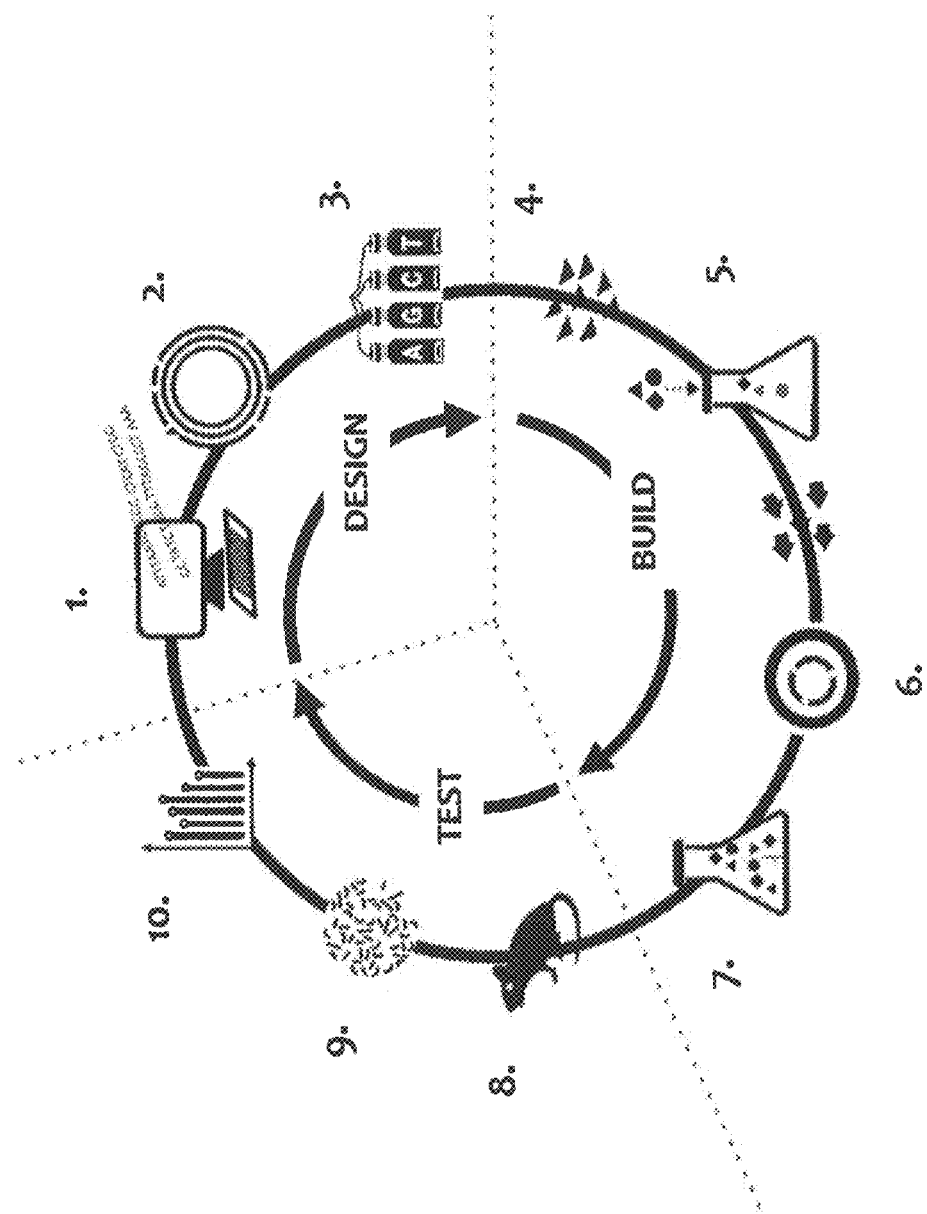
FIG. 67 depicts a schematic of a design-build-test cycle. Steps are as follows: 1: Define the disease pathway; 2. Identify target metabolites; 3. Design genetic circuits; 4. Build synthetic biotic; 5. Activate circuit in vivo; 6. Characterize circuit activation kinetics; 7. Optimize in vitro productivity to disease threshold; 8. Test optimize circuit in animal disease model; 9. Assimilate into the microbiome; 10. Develop understanding of in vivo PK and dosing regimen. Figure discloses SEQ ID NO: 292 and SEQ ID NO: 293, respectively, in order of appearance.
Figure 68:
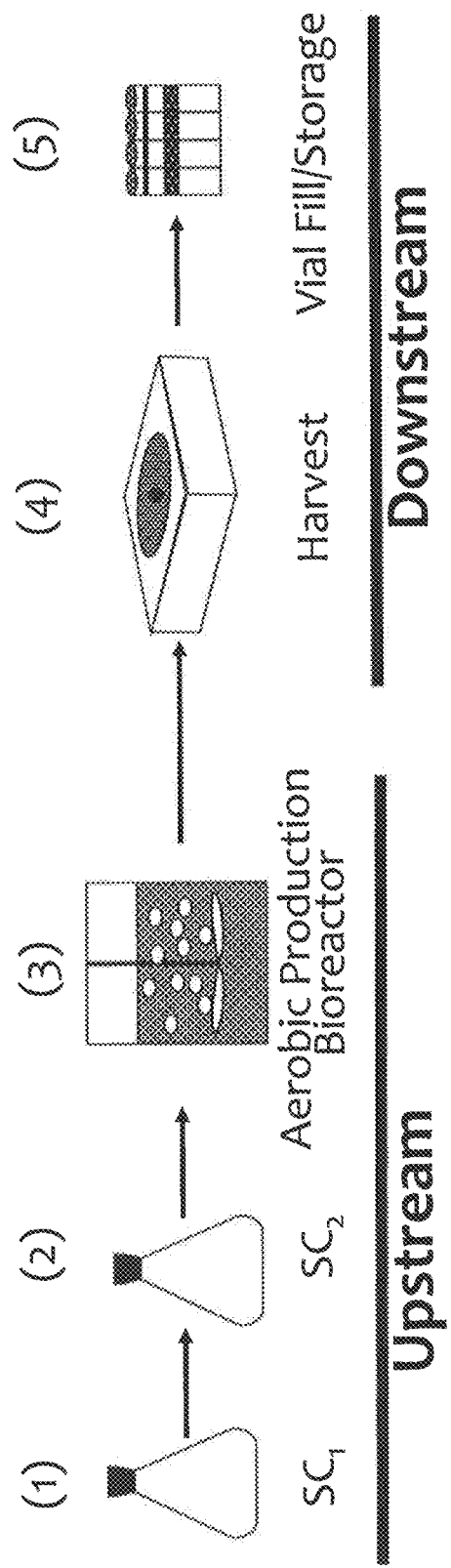
FIG. 68 depicts a schematic of non-limiting manufacturing processes for upstream and downstream production of the genetically engineered bacteria of the present disclosure. Step 1 depicts the parameters for starter culture 1 (SC1): loop full—glycerol stock, duration overnight, temperature 37° C., shaking at 250 rpm. Step 2 depicts the parameters for starter culture 2 (SC2): 1/100 dilution from SC1, duration 1.5 hours, temperature 37° C., shaking at 250 rpm. Step 3 depicts the parameters for the production bioreactor: inoculum—SC2, temperature 37° C., pH set point 7.00, pH dead band 0.05, dissolved oxygen set point 50%, dissolved oxygen cascade agitation/gas FLO, agitation limits 300-1200 rpm, gas FLO limits 0.5-20 standard liters per minute, duration 24 hours. Step 4 depicts the parameters for harvest: centrifugation at speed 4000 rpm and duration 30 minutes, wash 1×10% glycerol/PBS, centrifugation, re-suspension 10% glycerol/PBS. Step 5 depicts the parameters for vial fill/storage: 1-2 mL aliquots, −80° C.

In the above-described kill-switch circuits, a toxin is produced in the presence of an environmental factor or signal. In another aspect of kill-switch circuitry, a toxin may be repressed in the presence of an environmental factor (not produced) and then produced once the environmental condition or external signal is no longer present. Such kill switches are called repression-based kill switches and represent systems in which the bacterial cells are viable only in the presence of an external factor or signal, such as arabinose or other sugar. Exemplary kill switch designs in which the toxin is repressed in the presence of an external factor or signal (and activated once the external signal is removed) is shown in FIGS. 57, 60, 65. The disclosure provides recombinant bacterial cells which express one or more heterologous gene(s) upon sensing arabinose or other sugar in the exogenous environment. In this aspect, the recombinant bacterial cells contain the araC gene, which encodes the AraC transcription factor, as well as one or more genes under the control of the araBAD promoter. In the absence of arabinose, the AraC transcription factor adopts a conformation that represses transcription of genes under the control of the araBAD promoter. In the presence of arabinose, the AraC transcription factor undergoes a conformational change that allows it to bind to and activate the araBAD promoter, which induces expression of the desired gene, for example tetR, which represses expression of a toxin gene. In this embodiment, the toxin gene is repressed in the presence of arabinose or other sugar. In an environment where arabinose is not present, the tetR gene is not activated and the toxin is expressed, thereby killing the bacteria. The arabinose system can also be used to express an essential gene, in which the essential gene is only expressed in the presence of arabinose or other sugar and is not expressed when arabinose or other sugar is absent from the environment.

Thus, in some embodiments in which one or more heterologous gene(s) are expressed upon sensing arabinose in the exogenous environment, the one or more heterologous genes are directly or indirectly under the control of the araBAD promoter ($P_{araBAD}$). In some embodiments, the expressed heterologous gene is selected from one or more of the following: a heterologous therapeutic gene, a heterologous gene encoding an anti-toxin, a heterologous gene encoding a repressor protein or polypeptide, for example, a TetR repressor, a heterologous gene encoding an essential protein not found in the bacterial cell, and/or a heterologous encoding a regulatory protein or polypeptide.

Arabinose inducible promoters are known in the art, including $P_{ara}$, $P_{araB}$, $P_{araC}$, and $P_{araBAD}$. In one embodiment, the arabinose inducible promoter is from E. coli. In some embodiments, the $P_{araC}$ promoter and the $P_{araBAD}$ promoter operate as a bidirectional promoter, with the $P_{araBAD}$ promoter controlling expression of a heterologous gene(s) in one direction, and the $P_{araC}$ (in close proximity to, and on the opposite strand from the $P_{araBAD}$ promoter), controlling expression of a heterologous gene(s) in the other direction. In the presence of arabinose, transcription of both heterologous genes from both promoters is induced. However, in the absence of arabinose, transcription of both heterologous genes from both promoters is not induced.

In one exemplary embodiment of the disclosure, the genetically engineered bacteria of the present disclosure contains a kill-switch having at least the following sequences: a $P_{araBAD}$ promoter operably linked to a heterologous gene encoding a Tetracycline Repressor Protein (TetR), a $P_{araC}$ promoter operably linked to a heterologous gene encoding AraC transcription factor, and a heterologous gene encoding a bacterial toxin operably linked to a promoter which is repressed by the Tetracycline Repressor Protein ($P_{TetR}$). In the presence of arabinose, the AraC transcription factor activates the $P_{araBAD}$ promoter, which activates transcription of the TetR protein which, in turn, represses transcription of the toxin. In the absence of arabinose, however, AraC suppresses transcription from the $P_{araBAD}$ P promoter and no TetR protein is expressed. In this case, expression of the heterologous toxin gene is activated, and the toxin is expressed. The toxin builds up in the recombinant bacterial cell, and the recombinant bacterial cell is killed. In one embodiment, the araC gene encoding the AraC transcription factor is under the control of a constitutive promoter and is therefore constitutively expressed.

In one embodiment of the disclosure, the genetically engineered bacterium further comprises an anti-toxin under the control of a constitutive promoter. In this situation, in the presence of arabinose, the toxin is not expressed due to repression by TetR protein, and the anti-toxin protein builds-up in the cell. However, in the absence of arabinose, TetR protein is not expressed, and expression of the toxin is induced. The toxin begins to build-up within the recombinant bacterial cell. The recombinant bacterial cell is no longer viable once the toxin protein is present at either equal or greater amounts than that of the anti-toxin protein in the cell, and the recombinant bacterial cell will be killed by the toxin.

In another embodiment of the disclosure, the genetically engineered bacterium further comprises an anti-toxin under the control of the $P_{araBAD}$ promoter. In this situation, in the presence of arabinose, TetR and the anti-toxin are expressed, the anti-toxin builds up in the cell, and the toxin is not expressed due to repression by TetR protein. However, in the absence of arabinose, both the TetR protein and the anti-toxin are not expressed, and expression of the toxin is induced. The toxin begins to build-up within the recombinant bacterial cell. The recombinant bacterial cell is no longer viable once the toxin protein is expressed, and the recombinant bacterial cell will be killed by the toxin.

In another exemplary embodiment of the disclosure, the genetically engineered bacteria of the present disclosure contains a kill-switch having at least the following sequences: a $P_{araBAD}$ promoter operably linked to a heterologous gene encoding an essential polypeptide not found in the recombinant bacterial cell (and required for survival), and a $P_{araC}$ promoter operably linked to a heterologous gene encoding AraC transcription factor. In the presence of arabinose, the AraC transcription factor activates the $P_{araBAD}$ promoter, which activates transcription of the heterologous gene encoding the essential polypeptide, allowing the recombinant bacterial cell to survive. In the absence of arabinose, however, AraC suppresses transcription from the $P_{araBAD}$ promoter and the essential protein required for survival is not expressed. In this case, the recombinant bacterial cell dies in the absence of arabinose. In some embodiments, the sequence of $P_{araBAD}$ promoter operably linked to a heterologous gene encoding an essential polypeptide not found in the recombinant bacterial cell can be present in the bacterial cell in conjunction with the TetR/toxin kill-switch system described directly above. In some embodiments, the sequence of $P_{araBAD}$ promoter operably linked to a heterologous gene encoding an essential polypeptide not found in the recombinant bacterial cell can be present in the bacterial cell in conjunction with the TetR/toxin/anti-toxin kill-switch system described directly above.

In yet other embodiments, the bacteria may comprise a plasmid stability system with a plasmid that produces both a short-lived anti-toxin and a long-lived toxin. In this system, the bacterial cell produces equal amounts of toxin and anti-toxin to neutralize the toxin. However, if/when the cell loses the plasmid, the short-lived anti-toxin begins to decay. When the anti-toxin decays completely the cell dies as a result of the longer-lived toxin killing it.

In some embodiments, the engineered bacteria of the present disclosure further comprise the gene(s) encoding the components of any of the above-described kill-switch circuits.

In any of the above-described embodiments, the bacterial toxin may be selected from the group consisting of a lysin, Hok, Fst, TisB, LdrD, Kid, SymE, MazF, FlmA, Ibs, XCV2162, dinJ, CcdB, MazF, ParE, YafO, Zeta, hicB, relB, yhaV, yoeB, chpBK, hipA, microcin B, microcin B17, microcin C, microcin C7-051, microcin J25, microcin ColV, microcin 24, microcin L, microcin D93, microcin L, microcin E492, microcin H47, microcin 147, microcin M, colicin A, colicin E1, colicin K, colicin N, colicin U, colicin B, colicin Ia, colicin Ib, colicin 5, colicin10, colicin S4, colicin Y, colicin E2, colicin E7, colicin E8, colicin E9, colicin E3, colicin E4, colicin E6, colicin E5, colicin D, colicin M, and cloacin DF13, or a biologically active fragment thereof.

In any of the above-described embodiments, the anti-toxin may be selected from the group consisting of an anti-lysin, Sok, RNAII, IstR, RdlD, Kis, SymR, MazE, FlmB, Sib, ptaRNA1, yafQ, CcdA, MazE, ParD, yafN, Epsilon, HicA, relE, prlF, yefM, chpBl, hipB, MccE, $MccE^{CTD}$, MccF, Cai, ImmEl, Cki, Cni, Cui, Cbi, Iia, Imm, Cfi, Im10, Csi, Cyi, Im2, Im7, Im8, Im9, Im3, Im4, ImmE6, cloacin immunity protein (Cim), ImmE5, ImmD, and Cmi, or a biologically active fragment thereof.

In one embodiment, the bacterial toxin is bactericidal to the genetically engineered bacterium. In one embodiment, the bacterial toxin is bacteriostatic to the genetically engineered bacterium.

In some embodiments, the genetically engineered bacterium provided herein is an auxotroph. In one embodiment, the genetically engineered bacterium is an auxotroph selected from a cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thi1 auxotroph. In some embodiments, the engineered bacteria have more than one auxotrophy, for example, they may be a ΔthyA and ΔdapA auxotroph.

In some embodiments, the genetically engineered bacterium provided herein further comprises a kill-switch circuit, such as any of the kill-switch circuits provided herein. For example, in some embodiments, the genetically engineered bacteria further comprise one or more genes encoding one or more recombinase(s) under the control of an inducible promoter and an inverted toxin sequence. In some embodiments, the genetically engineered bacteria further comprise one or more genes encoding an anti-toxin. In some embodiments, the engineered bacteria further comprise one or more genes encoding one or more recombinase(s) under the control of an inducible promoter and one or more inverted excision genes, wherein the excision gene(s) encode an enzyme that deletes an essential gene. In some embodiments, the genetically engineered bacteria further comprise one or more genes encoding an anti-toxin. In some embodiments, the engineered bacteria further comprise one or more genes encoding a toxin under the control of a promoter having a TetR repressor binding site and a gene encoding the TetR under the control of an inducible promoter that is induced by arabinose, such as $P_{araBAD}$. In some embodiments, the genetically engineered bacteria further comprise one or more genes encoding an anti-toxin.

In some embodiments, the genetically engineered bacterium is an auxotroph comprising a therapeutic payload and further comprises a kill-switch circuit, such as any of the kill-switch circuits described herein.

In some embodiments of the above described genetically engineered bacteria, the gene or gene cassette for producing the anti-inflammation and/or gut barrier enhancer molecule is present on a plasmid in the bacterium and operatively linked on the plasmid to the inducible promoter. In other embodiments, the gene or gene cassette for producing the anti-inflammation and/or gut barrier enhancer molecule is present in the bacterial chromosome and is operatively linked in the chromosome to the inducible promoter.

Methods of Screening

Mutagenesis

In some embodiments, the inducible promoter is operably linked to a detectable product, e.g., GFP, and can be used to screen for mutants. In some embodiments, the inducible promoter is mutagenized, and mutants are selected based upon the level of detectable product, e.g., by flow cytometry, fluorescence-activated cell sorting (FACS) when the detectable product fluoresces. In some embodiments, one or more transcription factor binding sites is mutagenized to increase or decrease binding. In alternate embodiments, the wild-type binding sites are left intact and the remainder of the regulatory region is subjected to mutagenesis. In some embodiments, the mutant promoter is inserted into the genetically engineered bacteria of the invention to increase expression of the anti-inflammation and/or gut barrier enhancer molecule under inducing conditions, as compared to unmutated bacteria of the same subtype under the same conditions. In some embodiments, the inducible promoter and/or corresponding transcription factor is a synthetic, non-naturally occurring sequence.

In some embodiments, the gene encoding an anti-inflammation and/or gut barrier enhancer molecule is mutated to increase expression and/or stability of said molecule under inducing conditions, as compared to unmutated bacteria of the same subtype under the same conditions. In some embodiments, one or more of the genes in a gene cassette for producing an anti-inflammation and/or gut barrier enhancer molecule is mutated to increase expression of said molecule under inducing conditions, as compared to unmutated bacteria of the same subtype under the same conditions. In some embodiments, the efficacy or activity of any of the importers and exporters for metabolites of interest can be improved through mutations in any of these genes. Mutations increase uptake or export of such metabolites, including but not limited to, tryptophan, e.g., under inducing conditions, as compared to unmutated bacteria of the same subtype under the same conditions. Methods for directed mutation and screening are known in the art.

Generation of Bacterial Strains with Enhance Ability to Transport Metabolites of Interest Due to their ease of culture, short generation times, very high population densities and small genomes, microbes can be evolved to unique phenotypes in abbreviated timescales. Adaptive laboratory evolution (ALE) is the process of passaging microbes under selective pressure to evolve a strain with a preferred phenotype. Most commonly, this is applied to increase utilization of carbon/energy sources or adapting a strain to environmental stresses (e.g., temperature, pH), whereby mutant strains more capable of growth on the carbon substrate or under stress will outcompete the less adapted strains in the population and will eventually come to dominate the population.

This same process can be extended to any essential metabolite by creating an auxotroph. An auxotroph is a strain incapable of synthesizing an essential metabolite and must therefore have the metabolite provided in the media to grow. In this scenario, by making an auxotroph and passaging it on decreasing amounts of the metabolite, the resulting dominant strains should be more capable of obtaining and incorporating this essential metabolite.

For example, if the biosynthetic pathway for producing a metabolite of interest is disrupted a strain capable of high-affinity capture of the metabolite of interest can be evolved via ALE. First, the strain is grown in varying concentrations of the auxotrophic metabolite of interest, until a minimum concentration to support growth is established. The strain is then passaged at that concentration, and diluted into lowering concentrations of the metabolite of interest at regular intervals. Over time, cells that are most competitive for the metabolite of interest—at growth-limiting concentrations—will come to dominate the population. These strains will likely have mutations in their metabolite of interest-transporters resulting in increased ability to import the essential and limiting metabolite of interest.

Similarly, by using an auxotroph that cannot use an upstream metabolite to form the metabolite of interest, a strain can be evolved that not only can more efficiently import the upstream metabolite, but also convert the metabolite into the essential downstream metabolite of interest. These strains will also evolve mutations to increase import of the upstream metabolite, but may also contain mutations which increase expression or reaction kinetics of downstream enzymes, or that reduce competitive substrate utilization pathways.

A metabolite innate to the microbe can be made essential via mutational auxotrophy and selection applied with growth-limiting supplementation of the endogenous metabolite. However, phenotypes capable of consuming non-native compounds can be evolved by tying their consumption to the production of an essential compound. For example, if a gene from a different organism is isolated which can produce an essential compound or a precursor to an essential compound this gene can be recombinantly introduced and expressed in the heterologous host. This new host strain will now have the ability to synthesize an essential nutrient from a previously non-metabolizable substrate.

Hereby, a similar ALE process can be applied by creating an auxotroph incapable of converting an immediately downstream metabolite and selecting in growth-limiting amounts of the non-native compound with concurrent expression of the recombinant enzyme. This will result in mutations in the transport of the non-native substrate, expression and activity of the heterologous enzyme and expression and activity of downstream native enzymes. It should be emphasized that the key requirement in this process is the ability to tether the consumption of the non-native metabolite to the production of a metabolite essential to growth.

Once the basis of the selection mechanism is established and minimum levels of supplementation have been established, the actual ALE experimentation can proceed. Throughout this process several parameters must be vigilantly monitored. It is important that the cultures are maintained in an exponential growth phase and not allowed to reach saturation/stationary phase. This means that growth rates must be check during each passaging and subsequent dilutions adjusted accordingly. If growth rate improves to such a degree that dilutions become large, then the concentration of auxotrophic supplementation should be decreased such that growth rate is slowed, selection pressure is increased and dilutions are not so severe as to heavily bias subpopulations during passaging. In addition, at regular intervals cells should be diluted, grown on solid media and individual clones tested to confirm growth rate phenotypes observed in the ALE cultures.

Predicting when to halt the stop the ALE experiment also requires vigilance. As the success of directing evolution is tied directly to the number of mutations "screened" throughout the experiment and mutations are generally a function of errors during DNA replication, the cumulative cell divisions (CCD) acts as a proxy for total mutants which have been screened. Previous studies have shown that beneficial phenotypes for growth on different carbon sources can be isolated in about $10^{11.2}$ $CCD^1$. This rate can be accelerated by the addition of chemical mutagens to the cultures—such as N-methyl-N-nitro-N-nitrosoguanidine (NTG)—which causes increased DNA replication errors. However, when continued passaging leads to marginal or no improvement in growth rate the population has converged to some fitness maximum and the ALE experiment can be halted.

At the conclusion of the ALE experiment, the cells should be diluted, isolated on solid media and assayed for growth phenotypes matching that of the culture flask. Best performers from those selected are then prepped for genomic DNA and sent for whole genome sequencing. Sequencing with reveal mutations occurring around the genome capable of providing improved phenotypes, but will also contain silent mutations (those which provide no benefit but do not detract from desired phenotype). In cultures evolved in the presence of NTG or other chemical mutagen, there will be significantly more silent, background mutations. If satisfied with the best performing strain in its current state, the user can proceed to application with that strain. Otherwise the contributing mutations can be deconvoluted from the evolved strain by reintroducing the mutations to the parent strain by genome engineering techniques. See Lee, D.-H., Feist, A. M., Barrett, C. L. & Palsson, B. Ø. Cumulative Number of Cell Divisions as a Meaningful Timescale for Adaptive Laboratory Evolution of *Escherichia coli*. PLoS ONE 6, e26172 (2011).

Similar methods can be used to generate *E. coli* Nissle mutants that consume or import metabolites, including, but not limited to, tryptophan.

Pharmaceutical Compositions and Formulations

Pharmaceutical compositions comprising the genetically engineered microorganisms of the invention may be used to inhibit inflammatory mechanisms in the gut, restore and tighten gut mucosal barrier function, and/or treat or prevent autoimmune disorders. Pharmaceutical compositions comprising one or more genetically engineered bacteria, and/or one or more genetically engineered virus, alone or in combination with prophylactic agents, therapeutic agents, and/or pharmaceutically acceptable carriers are provided.

In certain embodiments, the pharmaceutical composition comprises one species, strain, or subtype of bacteria that are engineered to comprise the genetic modifications described herein, e.g., to produce an anti-inflammation and/or gut barrier enhancer molecule. In alternate embodiments, the pharmaceutical composition comprises two or more species, strains, and/or subtypes of bacteria that are each engineered to comprise the genetic modifications described herein, e.g., to produce an anti-inflammation and/or gut barrier enhancer molecule.

The pharmaceutical compositions described herein may be formulated in a conventional manner using one or more physiologically acceptable carriers comprising excipients and auxiliaries, which facilitate processing of the active ingredients into compositions for pharmaceutical use. Methods of formulating pharmaceutical compositions are known in the art (see, e.g., "Remington's Pharmaceutical Sciences," Mack Publishing Co., Easton, Pa.). In some embodiments, the pharmaceutical compositions are subjected to tabletting, lyophilizing, direct compression, conventional mixing, dissolving, granulating, levigating, emulsifying, encapsulating, entrapping, or spray drying to form tablets, granulates, nanoparticles, nanocapsules, microcapsules, microtablets, pellets, or powders, which may be enterically coated or uncoated. Appropriate formulation depends on the route of administration.

The genetically engineered microorganisms may be formulated into pharmaceutical compositions in any suitable dosage form (e.g., liquids, capsules, sachet, hard capsules, soft capsules, tablets, enteric coated tablets, suspension powders, granules, or matrix sustained release formations for oral administration) and for any suitable type of administration (e.g., oral, topical, injectable, intravenous, subcutaneous, immediate-release, pulsatile-release, delayed-release, or sustained release). Suitable dosage amounts for the genetically engineered bacteria may range from about 105 to 1012 bacteria, e.g., approximately 105 bacteria, approximately 106 bacteria, approximately 107 bacteria, approximately 108 bacteria, approximately 109 bacteria, approximately 1010 bacteria, approximately 1011 bacteria, or approximately 1011 bacteria. The composition may be administered once or more daily, weekly, or monthly. The composition may be administered before, during, or following a meal. In one embodiment, the pharmaceutical composition is administered before the subject eats a meal. In one embodiment, the pharmaceutical composition is administered currently with a meal. In on embodiment, the pharmaceutical composition is administered after the subject eats a meal The genetically engineered bacteria or genetically engineered virus may be formulated into pharmaceutical compositions comprising one or more pharmaceutically acceptable carriers, thickeners, diluents, buffers, buffering agents, surface active agents, neutral or cationic lipids, lipid complexes, liposomes, penetration enhancers, carrier compounds, and other pharmaceutically acceptable carriers or agents. For example, the pharmaceutical composition may include, but is not limited to, the addition of calcium bicarbonate, sodium bicarbonate, calcium phosphate, various sugars and types of starch, cellulose derivatives, gelatin, vegetable oils, polyethylene glycols, and surfactants, including, for example, polysorbate 20. In some embodiments, the genetically engineered bacteria of the invention may be formulated in a solution of sodium bicarbonate, e.g., 1 molar solution of sodium bicarbonate (to buffer an acidic cellular environment, such as the stomach, for example). The genetically engineered bacteria may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The genetically engineered microorganisms may be administered intravenously, e.g., by infusion or injection.

The genetically engineered microorganisms of the disclosure may be administered intrathecally. In some embodiments, the genetically engineered microorganisms of the invention may be administered orally. The genetically engineered microorganisms disclosed herein may be administered topically and formulated in the form of an ointment, cream, transdermal patch, lotion, gel, shampoo, spray, aerosol, solution, emulsion, or other form well known to one of skill in the art. See, e.g., "Remington's Pharmaceutical Sciences," Mack Publishing Co., Easton, Pa. In an embodiment, for non-sprayable topical dosage forms, viscous to semi-solid or solid forms comprising a carrier or one or more excipients compatible with topical application and having a dynamic viscosity greater than water are employed. Suitable formulations include, but are not limited to, solutions, suspensions, emulsions, creams, ointments, powders, liniments, salves, etc., which may be sterilized or mixed with auxiliary agents (e.g., preservatives, stabilizers, wetting agents, buffers, or salts) for influencing various properties, e.g., osmotic pressure. Other suitable topical dosage forms include sprayable aerosol preparations wherein the active ingredient in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms. Examples of such additional ingredients are well known in the art. In one embodiment, the pharmaceutical composition comprising the recombinant bacteria of the invention may be formulated as a hygiene product. For example, the hygiene product may be an antibacterial formulation, or a fermentation product such as a fermentation broth. Hygiene products may be, for example, shampoos, conditioners, creams, pastes, lotions, and lip balms.

The genetically engineered microorganisms disclosed herein may be administered orally and formulated as tablets, pills, dragees, capsules, liquids, gels, syrups, slurries, suspensions, etc. Pharmacological compositions for oral use can be made using a solid excipient, optionally grinding the resulting mixture, and processing the mixture of granules, after adding suitable auxiliaries if desired, to obtain tablets or dragee cores. Suitable excipients include, but are not limited to, fillers such as sugars, including lactose, sucrose, mannitol, or sorbitol; cellulose compositions such as maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP) or polyethylene glycol (PEG). Disintegrating agents may also be added, such as cross-linked polyvinylpyrrolidone, agar, alginic acid or a salt thereof such as sodium alginate.

Tablets or capsules can be prepared by conventional means with pharmaceutically acceptable excipients such as binding agents (e.g., pregelatinised maize starch, polyvinylpyrrolidone, hydroxypropyl methylcellulose, carboxymethylcellulose, polyethylene glycol, sucrose, glucose, sorbitol, starch, gum, kaolin, and tragacanth); fillers (e.g., lactose, microcrystalline cellulose, or calcium hydrogen phosphate); lubricants (e.g., calcium, aluminum, zinc, stearic acid, polyethylene glycol, sodium lauryl sulfate, starch, sodium benzoate, L-leucine, magnesium stearate, talc, or silica); disintegrants (e.g., starch, potato starch, sodium starch glycolate, sugars, cellulose derivatives, silica powders); or wetting agents (e.g., sodium lauryl sulphate). The tablets may be coated by methods well known in the art. A coating shell may be present, and common membranes include, but are not limited to, polylactide, polyglycolic acid, polyanhydride, other biodegradable polymers, alginate-polylysine-alginate (APA), alginate-polymethylene-co-guanidine-alginate (A-PMCG-A), hydroymethylacrylate-methyl methacrylate (HEMA-MMA), multilayered HEMA-MMA-MAA, polyacrylonitrilevinylchloride (PAN-PVC), acrylonitrile/sodium methallylsulfonate (AN-69), polyethylene glycol/poly pentamethylcyclopentasiloxane/polydimethylsiloxane (PEG/PD5/PDMS), poly N,N-dimethyl acrylamide (PDMAAm), siliceous encapsulates, cellulose sulphate/sodium alginate/polymethylene-co-guanidine (CS/A/PMCG), cellulose acetate phthalate, calcium alginate, k-carrageenan-locust bean gum gel beads, gellan-xanthan beads, poly(lactide-co-glycolides), carrageenan, starch poly-anhydrides, starch polymethacrylates, polyamino acids, and enteric coating polymers.

In some embodiments, the genetically engineered microorganisms are enterically coated for release into the gut or a particular region of the gut, for example, the large intestine. The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release. In some embodiments, at least two coatings are used. In some embodiments, the outside coating and the inside coating are degraded at different pH levels.

Liquid preparations for oral administration may take the form of solutions, syrups, suspensions, or a dry product for constitution with water or other suitable vehicle before use. Such liquid preparations may be prepared by conventional means with pharmaceutically acceptable agents such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of the genetically engineered microorganisms described herein.

In one embodiment, the genetically engineered microorganisms of the disclosure may be formulated in a composition suitable for administration to pediatric subjects. As is well known in the art, children differ from adults in many aspects, including different rates of gastric emptying, pH, gastrointestinal permeability, etc. (Ivanovska et al., Pediatrics, 134(2):361-372, 2014). Moreover, pediatric formulation acceptability and preferences, such as route of administration and taste attributes, are critical for achieving acceptable pediatric compliance. Thus, in one embodiment, the composition suitable for administration to pediatric subjects may include easy-to-swallow or dissolvable dosage forms, or more palatable compositions, such as compositions with added flavors, sweeteners, or taste blockers. In one embodiment, a composition suitable for administration to pediatric subjects may also be suitable for administration to adults.

In one embodiment, the composition suitable for administration to pediatric subjects may include a solution, syrup, suspension, elixir, powder for reconstitution as suspension or solution, dispersible/effervescent tablet, chewable tablet, gummy candy, lollipop, freezer pop, troche, chewing gum, oral thin strip, orally disintegrating tablet, sachet, soft gelatin capsule, sprinkle oral powder, or granules. In one embodiment, the composition is a gummy candy, which is made from a gelatin base, giving the candy elasticity, desired chewy consistency, and longer shelf-life. In some embodiments, the gummy candy may also comprise sweeteners or flavors.

In one embodiment, the composition suitable for administration to pediatric subjects may include a flavor. As used herein, "flavor" is a substance (liquid or solid) that provides a distinct taste and aroma to the formulation. Flavors also help to improve the palatability of the formulation. Flavors include, but are not limited to, strawberry, vanilla, lemon, grape, bubble gum, and cherry.

In certain embodiments, the genetically engineered microorganisms may be orally administered, for example, with an inert diluent or an assimilable edible carrier. The compound may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation.

In another embodiment, the pharmaceutical composition comprising the recombinant bacteria of the invention may be a comestible product, for example, a food product. In one embodiment, the food product is milk, concentrated milk, fermented milk (yogurt, sour milk, frozen yogurt, lactic acid bacteria-fermented beverages), milk powder, ice cream, cream cheeses, dry cheeses, soybean milk, fermented soybean milk, vegetable-fruit juices, fruit juices, sports drinks, confectionery, candies, infant foods (such as infant cakes), nutritional food products, animal feeds, or dietary supplements. In one embodiment, the food product is a fermented food, such as a fermented dairy product. In one embodiment, the fermented dairy product is yogurt. In another embodiment, the fermented dairy product is cheese, milk, cream, ice cream, milk shake, or kefir. In another embodiment, the recombinant bacteria of the invention are combined in a preparation containing other live bacterial cells intended to serve as probiotics. In another embodiment, the food product is a beverage. In one embodiment, the beverage is a fruit juice-based beverage or a beverage containing plant or herbal extracts. In another embodiment, the food product is a jelly or a pudding. Other food products suitable for administration of the recombinant bacteria of the invention are well known in the art. For example, see U.S. 2015/0359894 and US 2015/0238545, the entire contents of each of which are expressly incorporated herein by reference. In yet another embodiment, the pharmaceutical composition of the invention is injected into, sprayed onto, or sprinkled onto a food product, such as bread, yogurt, or cheese.

In some embodiments, the composition is formulated for intraintestinal administration, intrajejunal administration, intraduodenal administration, intraileal administration, gastric shunt administration, or intracolic administration, via nanoparticles, nanocapsules, microcapsules, or microtablets, which are enterically coated or uncoated. The pharmaceutical compositions may also be formulated in rectal compositions such as suppositories or retention enemas, using, e.g., conventional suppository bases such as cocoa butter or other glycerides. The compositions may be suspensions, solutions, or emulsions in oily or aqueous vehicles, and may contain suspending, stabilizing and/or dispersing agents.

The genetically engineered microorganisms described herein may be administered intranasally, formulated in an aerosol form, spray, mist, or in the form of drops, and conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). Pressurized aerosol dosage units may be determined by providing a valve to deliver a metered amount. Capsules and cartridges (e.g., of gelatin) for use in an inhaler or insufflator may be formulated containing a powder mix of the compound and a suitable powder base such as lactose or starch.

The genetically engineered microorganisms may be administered and formulated as depot preparations. Such long acting formulations may be administered by implantation or by injection, including intravenous injection, subcutaneous injection, local injection, direct injection, or infusion. For example, the compositions may be formulated with suitable polymeric or hydrophobic materials (e.g., as an emulsion in an acceptable oil) or ion exchange resins, or as sparingly soluble derivatives (e.g., as a sparingly soluble salt).

In some embodiments, disclosed herein are pharmaceutically acceptable compositions in single dosage forms. Single dosage forms may be in a liquid or a solid form. Single dosage forms may be administered directly to a patient without modification or may be diluted or reconstituted prior to administration. In certain embodiments, a single dosage form may be administered in bolus form, e.g., single injection, single oral dose, including an oral dose that comprises multiple tablets, capsule, pills, etc. In alternate embodiments, a single dosage form may be administered over a period of time, e.g., by infusion.

Single dosage forms of the pharmaceutical composition may be prepared by portioning the pharmaceutical composition into smaller aliquots, single dose containers, single dose liquid forms, or single dose solid forms, such as tablets, granulates, nanoparticles, nanocapsules, microcapsules, microtablets, pellets, or powders, which may be enterically coated or uncoated. A single dose in a solid form may be reconstituted by adding liquid, typically sterile water or saline solution, prior to administration to a patient.

In other embodiments, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(-hydroxy ethyl methacrylate), poly(methyl methacrylate), poly(acrylic acid), poly(ethylene-co-vinyl acetate), poly (methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

Dosage regimens may be adjusted to provide a therapeutic response. Dosing can depend on several factors, including severity and responsiveness of the disease, route of administration, time course of treatment (days to months to years), and time to amelioration of the disease. For example, a single bolus may be administered at one time, several divided doses may be administered over a predetermined period of time, or the dose may be reduced or increased as indicated by the therapeutic situation. The specification for the dosage is dictated by the unique characteristics of the active compound and the particular therapeutic effect to be achieved. Dosage values may vary with the type and severity of the condition to be alleviated. For any particular subject, specific dosage regimens may be adjusted over time according to the individual need and the professional judgment of the treating clinician. Toxicity and therapeutic efficacy of compounds provided herein can be determined by standard pharmaceutical procedures in cell culture or animal models. For example, LD50, ED50, EC50, and IC50 may be determined, and the dose ratio between toxic and therapeutic effects (LD50/ED50) may be calculated as the therapeutic index. Compositions that exhibit toxic side effects may be used, with careful modifications to minimize potential damage to reduce side effects. Dosing may be estimated initially from cell culture assays and animal models. The data obtained from in vitro and in vivo assays and animal studies can be used in formulating a range of dosage for use in humans.

The ingredients are supplied either separately or mixed together in unit dosage form, for example, as a dry lyophilized powder or water-free concentrate in a hermetically sealed container such as an ampoule or sachet indicating the quantity of active agent. If the mode of administration is by injection, an ampoule of sterile water for injection or saline can be provided so that the ingredients may be mixed prior to administration.

The pharmaceutical compositions may be packaged in a hermetically sealed container such as an ampoule or sachet indicating the quantity of the agent. In one embodiment, one or more of the pharmaceutical compositions is supplied as a dry sterilized lyophilized powder or water-free concentrate in a hermetically sealed container and can be reconstituted (e.g., with water or saline) to the appropriate concentration for administration to a subject. In an embodiment, one or more of the prophylactic or therapeutic agents or pharmaceutical compositions is supplied as a dry sterile lyophilized powder in a hermetically sealed container stored between 2° C. and 8° C. and administered within 1 hour, within 3 hours, within 5 hours, within 6 hours, within 12 hours, within 24 hours, within 48 hours, within 72 hours, or within one week after being reconstituted. Cryoprotectants can be included for a lyophilized dosage form, principally 0-10% sucrose (optimally 0.5-1.0%). Other suitable cryoprotectants include trehalose and lactose. Other suitable bulking agents include glycine and arginine, either of which can be included at a concentration of 0-0.05%, and polysorbate-80 (optimally included at a concentration of 0.005-0.01%). Additional surfactants include but are not limited to polysorbate 20 and BRIJ surfactants. The pharmaceutical composition may be prepared as an injectable solution and can further comprise an agent useful as an adjuvant, such as those used to increase absorption or dispersion, e.g., hyaluronidase.

Methods of Treatment

Another aspect of the invention provides methods of treating autoimmune disorders, diarrheal diseases, IBD, related diseases, and other diseases that benefit from reduced gut inflammation and/or enhanced gut barrier function. In some embodiments, the invention provides for the use of at least one genetically engineered species, strain, or subtype of bacteria described herein for the manufacture of a medicament. In some embodiments, the invention provides for the use of at least one genetically engineered species, strain, or subtype of bacteria described herein for the manufacture of a medicament for treating autoimmune disorders, diarrheal diseases, IBD, related diseases, and other diseases that benefit from reduced gut inflammation and/or enhanced gut barrier function. In some embodiments, the invention provides at least one genetically engineered species, strain, or subtype of bacteria described herein for use in treating autoimmune disorders, diarrheal diseases, IBD, related diseases, and other diseases that benefit from reduced gut inflammation and/or enhanced gut barrier function.

In some embodiments, the diarrheal disease is selected from the group consisting of acute watery diarrhea, e.g., cholera, acute bloody diarrhea, e.g., dysentery, and persistent diarrhea. In some embodiments, the IBD or related disease is selected from the group consisting of Crohn's disease, ulcerative colitis, collagenous colitis, lymphocytic colitis, diversion colitis, Behcet's disease, intermediate colitis, short bowel syndrome, ulcerative proctitis, proctosigmoiditis, left-sided colitis, pancolitis, and fulminant colitis. In some embodiments, the disease or condition is an autoimmune disorder selected from the group consisting of acute disseminated encephalomyelitis (ADEM), acute necrotizing hemorrhagic leukoencephalitis, Addison's disease, agammaglobulinemia, alopecia areata, amyloidosis, ankylosing spondylitis, anti-GBM/anti-TBM nephritis, antiphospholipid syndrome (APS), autoimmune angioedema, autoimmune aplastic anemia, autoimmune dysautonomia, autoimmune hemolytic anemia, autoimmune hepatitis, autoimmune hyperlipidemia, autoimmune immunodeficiency, autoimmune inner ear disease (AIED), autoimmune myocarditis, autoimmune oophoritis, autoimmune pancreatitis, autoimmune retinopathy, autoimmune thrombocytopenic purpura (ATP), autoimmune thyroid disease, autoimmune urticarial, axonal & neuronal neuropathies, Balo disease, Behcet's disease, bullous pemphigoid, cardiomyopathy, Castleman disease, celiac disease, Chagas disease, chronic inflammatory demyelinating polyneuropathy (CIDP), chronic recurrent multifocal ostomyelitis (CRMO), Churg-Strauss syndrome, cicatricial pemphigoid/benign mucosal pemphigoid, Crohn's disease, Cogan's syndrome, cold agglutinin disease, congenital heart block, Coxsackie myocarditis, CREST disease, essential mixed cryoglobulinemia, demyelinating neuropathies, dermatitis herpetiformis, dermatomyositis, Devic's disease (neuromyelitis optica), discoid lupus, Dressler's syndrome, endometriosis, eosinophilic esophagitis, eosinophilic fasciitis, erythema nodosum, experimental allergic encephalomyelitis, Evans syndrome, fibrosing alveolitis, giant cell arteritis (temporal arteritis), giant cell myocarditis, glomerulonephritis, Goodpasture's syndrome, granulomatosis with polyangiitis (GPA), Graves' disease, Guillain-Barre syndrome, Hashimoto's encephalitis, Hashimoto's thyroiditis, hemolytic anemia, Henoch-Schonlein purpura, herpes gestationis, hypogammaglobulinemia, idiopathic thrombocytopenic purpura (ITP), IgA nephropathy, IgG4-related sclerosing disease, immunoregulatory lipoproteins, inclusion body myositis, interstitial cystitis, juvenile arthritis, juvenile idiopathic arthritis, juvenile myositis, Kawasaki syndrome, Lambert-Eaton syndrome, leukocytoclastic vasculitis, lichen planus, lichen sclerosus, ligneous conjunctivitis, linear IgA disease (LAD), lupus (systemic lupus erythematosus), chronic Lyme disease, Meniere's disease, microscopic polyangiitis, mixed connective tissue disease (MCTD), Mooren's ulcer, Mucha-Habermann disease, multiple sclerosis, myasthenia gravis, myositis, narcolepsy, neuromyelitis optica (Devic's), neutropenia, ocular cicatricial pemphigoid, optic neuritis, palindromic rheumatism, PANDAS (Pediatric Autoimmune Neuropsychiatric Disorders Associated with *Streptococcus*), paraneoplastic cerebellar degeneration, paroxysmal nocturnal hemoglobinuria (PNH), Parry Romberg syndrome, Parsonnage-Turner syndrome, pars planitis (peripheral uveitis), pemphigus, peripheral neuropathy, perivenous encephalomyelitis, pernicious anemia, POEMS syndrome, polyarteritis *nodosa*, type I, II, & III autoimmune polyglandular syndromes, polymyalgia rheumatic, polymyositis, postmyocardial infarction syndrome, postpericardiotomy syndrome, progesterone dermatitis, primary biliary cirrhosis, primary sclerosing cholangitis, psoriasis, psoriatic arthritis, idiopathic pulmonary fibrosis, pyoderma gangrenosum, pure red cell aplasia, Raynaud's phenomenon, reactive arthritis, reflex sympathetic dystrophy, Reiter's syndrome, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm & testicular autoimmunity, stiff person syndrome, subacute bacterial endocarditis (SBE), Susac's syndrome, sympathetic ophthalmia, Takayasu's arteritis, temporal arteritis/giant cell arteritis, thrombocytopenic purpura (TTP), Tolosa-Hunt syndrome, transverse myelitis, type 1 diabetes, asthma, ulcerative colitis, undifferentiated connective tissue disease (UCTD), uveitis, vasculitis, vesiculobullous dermatosis, vitiligo, and Wegener's granulomatosis. In some embodiments, the invention provides methods for reducing, ameliorating, or eliminating one or more symptom(s) associated with these diseases, including but not limited to diarrhea, bloody stool, mouth sores, perianal disease, abdominal pain, abdominal cramping, fever, fatigue, weight loss, iron deficiency, anemia, appetite loss, weight loss, anorexia, delayed growth, delayed pubertal development, and inflammation of the skin, eyes, joints, liver, and bile ducts. In some embodiments, the invention provides methods for reducing gut inflammation and/or enhancing gut barrier function, thereby ameliorating or preventing a systemic autoimmune disorder, e.g., asthma (Arrieta et al., 2015).

The method may comprise preparing a pharmaceutical composition with at least one genetically engineered species, strain, or subtype of bacteria described herein, and administering the pharmaceutical composition to a subject in a therapeutically effective amount. In some embodiments, the genetically engineered bacteria of the invention are administered orally in a liquid suspension. In some embodiments, the genetically engineered bacteria of the invention are lyophilized in a gel cap and administered orally. In some embodiments, the genetically engineered bacteria of the invention are administered via a feeding tube. In some embodiments, the genetically engineered bacteria of the invention are administered rectally, e.g., by enema. In some embodiments, the genetically engineered bacteria of the invention are administered topically, intraintestinally, intrajejunally, intraduodenally, intraileally, and/or intracolically.

In some embodiments, the genetically engineered viruses are prepared for delivery, taking into consideration the need for efficient delivery and for overcoming the host antiviral immune response. Approaches to evade antiviral response include the administration of different viral serotypes as par of the treatment regimen (serotype switching), formulation, such as polymer coating to mask the virus from antibody recognition and the use of cells as delivery vehicles.

In another embodiment, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

The genetically engineered bacteria of the invention may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

In certain embodiments, the pharmaceutical composition described herein is administered to reduce gut inflammation, enhance gut barrier function, and/or treat or prevent an autoimmune disorder in a subject. In some embodiments, the methods of the present disclosure may reduce gut inflammation in a subject by at least about 10%, 20%, 25%, 30%, 40%, 50%, 60%, 70%, 75%, 80%, 85%, 90%, 95%, or more as compared to levels in an untreated or control subject. In some embodiments, the methods of the present disclosure may enhance gut barrier function in a subject by at least about 10%, 20%, 25%, 30%, 40%, 50%, 60%, 70%, 75%, 80%, 85%, 90%, 95%, or more as compared to levels in an untreated or control subject. In some embodiments, changes in inflammation and/or gut barrier function are measured by comparing a subject before and after administration of the pharmaceutical composition. In some embodiments, the method of treating or ameliorating the autoimmune disorder and/or the disease or condition associated with gut inflammation and/or compromised gut barrier function allows one or more symptoms of the disease or condition to improve by at least about 10%, 20%, 30%, 40%, 50%, 60%, 70%, 80%, 90%, 95%, or more.

In some embodiments, reduction is measured by comparing the levels of inflammation in a subject before and after administration of the pharmaceutical composition. In one embodiment, the levels of inflammation is reduced in the gut of the subject. In one embodiment, gut barrier function is enhanced in the gut of the subject. In another embodiment, levels of inflammation is reduced in the blood of the subject. In another embodiment, the levels of inflammation is reduced in the plasma of the subject. In another embodiment, levels of inflammation is reduced in the brain of the subject.

In one embodiment, the pharmaceutical composition described herein is administered to reduce levels of inflammation in a subject to normal levels. In another embodiment, the pharmaceutical composition described herein is administered to reduce levels of inflammation in a subject below normal.

In some embodiments, the method of treating the autoimmune disorder allows one or more symptoms of the condition or disorder to improve by at least about 10%, 20%, 30%, 40%, 50%, 60%, 70%, 80%, 90%, 95%, or more. In some embodiments, the method of treating the disorder, allows one or more symptoms of the condition or disorder to improve by at least about two-fold, three-fold, four-fold, five-fold, six-fold, seven-fold, eight-fold, nine-fold, or ten-fold.

Before, during, and after the administration of the pharmaceutical composition, gut inflammation and/or barrier function in the subject may be measured in a biological sample, such as blood, serum, plasma, urine, fecal matter, peritoneal fluid, intestinal mucosal scrapings, a sample collected from a tissue, and/or a sample collected from the contents of one or more of the following: the stomach, duodenum, jejunum, ileum, cecum, colon, rectum, and anal canal. In some embodiments, the methods may include administration of the compositions of the invention to enhance gut barrier function and/or to reduce gut inflammation to baseline levels, e.g., levels comparable to those of a healthy control, in a subject. In some embodiments, the methods may include administration of the compositions of the invention to reduce gut inflammation to undetectable levels in a subject, or to less than about 1%, 2%, 5%, 10%, 20%, 25%, 30%, 40%, 50%, 60%, 70%, 75%, or 80% of the subject's levels prior to treatment. In some embodiments, the methods may include administration of the compositions of the invention to enhance gut barrier function in a subject by about 1%, 2%, 5%, 10%, 20%, 25%, 30%, 40%, 50%, 60%, 70%, 75%, 80%, 90%, 100% or more of the subject's levels prior to treatment.

In certain embodiments, the recombinant bacteria are *E. coli* Nissle. The recombinant bacteria may be destroyed, e.g., by defense factors in the gut or blood serum (Sonnenborn et al., 2009) or by activation of a kill switch, several hours or days after administration. Thus, the pharmaceutical composition comprising the recombinant bacteria may be re-administered at a therapeutically effective dose and frequency. In alternate embodiments, the recombinant bacteria are not destroyed within hours or days after administration and may propagate and colonize the gut.

The pharmaceutical composition may be administered alone or in combination with one or more additional therapeutic agents, e.g., corticosteroids, aminosalicylates, anti-inflammatory agents. In some embodiments, the pharmaceutical composition is administered in conjunction with an anti-inflammatory drug (e.g., mesalazine, prednisolone, methylprednisolone, butesonide), an immunosuppressive drug (e.g., azathioprine, 6-mercaptopurine, methotrexate, cyclosporine, tacrolimus), an antibiotic (e.g., metronidazole, ornidazole, clarithromycin, rifaximin, ciprofloxacin, anti-TB), other probiotics, and/or biological agents (e.g., infliximab, adalimumab, certolizumab pegol) (Triantafillidis et al., 2011). An important consideration in the selection of the one or more additional therapeutic agents is that the agent(s) should be compatible with the genetically engineered bacteria of the invention, e.g., the agent(s) must not kill the bacterialn one embodiments, the bacterial cells disclosed herein are administered to a subject once daily. In another embodiment, the bacterial cells disclosed herein are administered to a subject twice daily. In another embodiment, the bacterial cells disclosed herein are administered to a subject in combination with a meal. In another embodiment, the bacterial cells disclosed herein are administered to a subject prior to a meal. In another embodiment, the bacterial cells disclosed herein are administered to a subject after a meal. The dosage of the pharmaceutical composition and the frequency of administration may be selected based on the severity of the symptoms and the progression of the disease. The appropriate therapeutically effective dose and/or frequency of administration can be selected by a treating clinician.

Treatment In Vivo

The genetically engineered bacteria of the invention may be evaluated in vivo, e.g., in an animal model. Any suitable animal model of a disease or condition associated with gut inflammation, compromised gut barrier function, and/or an autoimmune disorder may be used (see, e.g., Mizoguchi, 2012). The animal model may be a mouse model of IBD, e.g., a CD45RB$^{Hi}$ T cell transfer model or a dextran sodium sulfate (DSS) model. The animal model may be a mouse model of type 1 diabetes (T1D), and T1D may be induced by treatment with streptozotocin.

Colitis is characterized by inflammation of the inner lining of the colon, and is one form of IBD. In mice, modeling colitis often involves the aberrant expression of T cells and/or cytokines. One exemplary mouse model of IBD can be generated by sorting CD4+ T cells according to their levels of CD45RB expression, and adoptively transferring CD4+ T cells with high CD45RB expression from normal donor mice into immunodeficient mice. Non-limiting examples of immunodeficient mice that may be used for transfer include severe combined immunodeficient (SCID) mice (Morrissey et al., 1993; Powrie et al., 1993), and recombination activating gene 2 (RAG2)-deficient mice (Corazza et al., 1999). The transfer of CD45RB$^{Hi}$ T cells into immunodeficient mice, e.g., via intravenous or intraperitoneal injection, results in epithelial cell hyperplasia, tissue damage, and severe mononuclear cell infiltration within the colon (Byrne et al., 2005; Dohi et al., 2004; Wei et al., 2005). In some embodiments, the genetically engineered bacteria of the invention may be evaluated in a CD45RB$^{Hi}$ T cell transfer mouse model of IBD.

Another exemplary animal model of IBD can be generated by supplementing the drinking water of mice with dextran sodium sulfate (DSS) (Martinez et al., 2006; Okayasu et al., 1990; Whittem et al., 2010). Treatment with DSS results in epithelial damage and robust inflammation in the colon lasting several days. Single treatments may be used to model acute injury, or acute injury followed by repair. Mice treated acutely show signs of acute colitis, including bloody stool, rectal bleeding, diarrhea, and weight loss (Okayasu et al., 1990). In contrast, repeat administration cycles of DSS may be used to model chronic inflammatory disease. Mice that develop chronic colitis exhibit signs of colonic mucosal regeneration, such as dysplasia, lymphoid follicle formation, and shortening of the large intestine (Okayasu et al., 1990). In some embodiments, the genetically engineered bacteria of the invention may be evaluated in a DSS mouse model of IBD.

In some embodiments, the genetically engineered bacteria of the invention is administered to the animal, e.g., by oral gavage, and treatment efficacy is determined, e.g., by endoscopy, colon translucency, fibrin attachment, mucosal and vascular pathology, and/or stool characteristics. In some embodiments, the animal is sacrificed, and tissue samples are collected and analyzed, e.g., colonic sections are fixed and scored for inflammation and ulceration, and/or homogenized and analyzed for myeloperoxidase activity and cytokine levels (e.g., IL-1β, TNF-α, IL-6, IFN-γ and IL-10).

REFERENCES

Aboulnaga et al. Effect of an oxygen-tolerant bifurcating butyryl coenzyme A dehydrogenase/electron-transferring flavoprotein complex from *Clostridium difficile* on butyrate production in *Escherichia coli*. J Bact. 2013; 195(16):3704-13. PMID: 23772070.

Ahmad et al. scFv antibody: principles and clinical application. Clin Dev Immunol. 2012; 2012:980250. PMID: 22474489.

Alavi et al. Treatment of inflammatory bowel disease in a rodent model with the intestinal growth factor glucagon-like peptide-2. J. Pediatr Surg. 2000 June; 35(6):847-51. PMID: 10873024.

Albiniak et al. High-level secretion of a recombinant protein to the culture medium with a *Bacillus subtilis* twin-arginine translocation system in *Escherichia coli*. FEBS J. 2013; 280(16):3810-21. PMID: 23745597.

Altenhoefer et al. The probiotic *Escherichia coli* strain Nissle 1917 interferes with invasion of human intestinal epithelial cells by different enteroinvasive bacterial pathogens. FEMS Immunol Med Microbiol. 2004 Apr. 9; 40(3):223-9. PMID: 15039098.

Alvarado et al. Targeting the Broadly Pathogenic Kynurenine Pathway. 2015. Sandeep, ed. Springer International Publishing: Switzerland.

Appleyard C B, Wallace J L. Reactivation of hapten-induced colitis and its prevention by anti-inflammatory drugs. Am J. Physiol. 1995 July; 269(1 Pt 1):G119-25. PMID: 7631788.

Arai et al. Expression of the nir and nor genes for denitrification of *Pseudomonas aeruginosa* requires a novel CRP/FNR-related transcriptional regulator, DNR, in addition to ANR. FEBS Lett. 1995 Aug. 28; 371(1):73-6. PMID: 7664887.

Arrieta et al. Early infancy microbial and metabolic alterations affect risk of childhood asthma. Sci Transl Med. 2015 Sep. 30; 7(307):307ra152. PMID: 26424567.

Arthur et al. Intestinal inflammation targets cancer-inducing activity of the microbiota. Science. 2012 Oct. 5; 338 (6103):120-3. PMID: 22903521.

Atarashi et al. Induction of colonic regulatory T cells by indigenous *Clostridium* species. Science. 2011 Jan. 21; 331(6015):337-41. PMID: 21205640.

Boirivant et al. Oxazolone colitis: a murine model of T helper cell type 2 colitis treatable with antibodies to interleukin 4. J Exp Med. 1998 Nov. 16; 188(10):1929-39. PMID: 9815270.

Bramhall et al. Quality of methods reporting in animal models of colitis. Inflamm Bowel Dis. 2015 June; 21(6): 1248-59. PMID: 25989337.

Byrne et al. CD4+CD45RBHi T cell transfer induced colitis in mice is accompanied by osteopenia which is treatable with recombinant human osteoprotegerin. Gut. 2005 January; 54(1):78-86. PMID: 15591508.

Callura et al. Tracking, Tuning and terminating microbial physiology using synthetic riboregulators. Proc Natl Acad Sci. 2010; 27(36):15898-903. PMID: 20713708.

Castiglione et al. The transcription factor DNR from *Pseudomonas aeruginosa* specifically requires nitric oxide and haem for the activation of a target promoter in *Escherichia coli*. Microbiology. 2009 September; 155(Pt 9):2838-44. PMID: 19477902.

Chassaing et al. Dextran sulfate sodium (DSS)-induced colitis in mice. Curr Protoc Immunol. 2014 Feb. 4; 104:Unit 15.25. PMID: 24510619.

Chassaing et al. Fecal lipocalin 2, a sensitive and broadly dynamic non-invasive biomarker for intestinal inflammation. PLoS One. 2012; 7(9):e44328. PMID: 22957064.

Ciorba et al. Induction of IDO-1 by immunostimulatory DNA limits severity of experimental colitis. J Immunol. 2010 Apr. 1; 184(7):3907-16. PMID: 20181893.

Clarkson et al. Diaminopimelic acid and lysine auxotrophs of *Pseudomonas aeruginosa* 8602. J Gen Microbiol. 1971 May; 66(2):161-9. PMID: 4999073.

Cohen et al. Biologic therapies in inflammatory bowel disease. Transl Res. 2014 June; 163(6):533-56. PMID: 24467968.

Collinson et al. Channel crossing: how are proteins shipped across the bacterial plasma membrane? Philos Trans R Soc Lond B Biol Sci. 2015; 370: 20150025. PMID: 26370937.

Corazza et al. Nonlymphocyte-derived tumor necrosis factor is required for induction of colitis in recombination activating gene (RAG)2(−/−) mice upon transfer of CD4(+) CD45RB(hi) T cells. J Exp Med. 1999 Nov. 15; 190(10): 1479-92. PMID: 10562322.

Costa et al. Secretion systems in Gram-negative bacteria: structural and mechanistic insights. Nat Rev Microbiol. 2015; 13(6):343-59. PMID: 25978706.

Cuevas-Ramos et al. *Escherichia coli* induces DNA damage in vivo and triggers genomic instability in mammalian cells. Proc Natl Acad Sci USA. 2010 Jun. 22; 107(25): 11537-42. PMID: 20534522.

Cutting. *Bacillus* probiotics. Food Microbiol. 2011 April; 28(2):214-20. PMID: 21315976.

Danino et al. Programmable probiotics for detection of cancer in urine. Sci Transl Med. 2015 May 27; 7(289): 289ra84. PMID: 26019220.

Davis-Richardson et al. A model for the role of gut bacteria in the development of autoimmunity for type 1 diabetes. Diabetologia. 2015 July; 58(7):1386-93. PMID: 25957231.

Dinleyici et al. *Saccharomyces boulardii* CNCM 1-745 in different clinical conditions. Expert Opin Biol Ther. 2014 November; 14(11):1593-609. PMID: 24995675.

Dohi et al. CD4+CD45RBHi interleukin-4 defective T cells elicit antral gastritis and duodenitis. Am J Pathol. 2004 October; 165(4):1257-68. PMID: 15466391.

Eiglmeier et al. Molecular genetic analysis of FNR-dependent promoters. Mol Microbiol. 1989 July; 3(7):869-78. PMID: 2677602.

Elson et al. The C3H/HeJBir mouse model: a high susceptibility phenotype for colitis. Int Rev Immunol. 2000; 19(1):63-75. PMID: 10723678.

El-Zaatari et al. Tryptophan catabolism restricts IFN-γ-expressing neutrophils and *Clostridium difficile* immunopathology. J Immunol. 2014 Jul. 15; 193(2):807-16. PMID: 24935925.

Erben et al. A guide to histomorphological evaluation of intestinal inflammation in mouse models. Int J Clin Exp Pathol. 2014 Jul. 15; 7(8):4557-76. PMID: 25197329.

Fasano A, Shea-Donohue T. Mechanisms of disease: the role of intestinal barrier function in the pathogenesis of gastrointestinal autoimmune diseases. Nat Clin Pract Gastroenterol Hepatol. 2005 September; 2(9):416-22. PMID: 16265432.

Fasano. Leaky gut and autoimmune diseases. Clin Rev Allergy Immunol. 2012 February; 42(1):71-8. PMID: 22109896.

Ferdinande et al. Inflamed intestinal mucosa features a specific epithelial expression pattern of indoleamine 2,3-dioxygenase. Int J Immunopathol Pharmacol. 2008 April-June; 21(2):289-95. PMID: 18547472.

Forrest et al. Levels of purine, kynurenine and lipid peroxidation products in patients with inflammatory bowel disease. In: Developments in Tryptophan and Serotonin Metabolism. 2003; 527:395-400. Allegri et al., ed. Springer Science+Business Media: New York.

Frenzel et al. Expression of recombinant antibodies. Front Immunol. 2013; 4:217. PMID: 23908655.

Furusawa et al. Commensal microbe-derived butyrate induces the differentiation of colonic regulatory T cells. Nature. 2013; 504:446-50. PMID: 24226770.

Galimand et al. Positive FNR-like control of anaerobic arginine degradation and nitrate respiration in *Pseudomonas aeruginosa*. J Bacteriol. 1991 March; 173(5):1598-606. PMID: 1900277.

Gardner et al. Construction of a genetic toggle switch in *Escherichia coli*. Nature. 2000; 403:339-42. PMID: 10659857.

Garrett et al. Communicable ulcerative colitis induced by T-bet deficiency in the innate immune system. Cell. 2007 Oct. 5; 131(1):33-45. PMID: 17923086.

Gerlach et al. Protein secretion systems and adhesins: the molecular armory of Gram-negative pathogens. Int J Med Microbiol. 2007; 297:401-15. PMID: 17482513.

Ghishan et al. Epithelial transport in inflammatory bowel diseases. Inflamm Bowel Dis. 2014 June; 20(6):1099-109. PMID: 24691115.

Gurtner et al. Inhibition of indoleamine 2,3-dioxygenase augments trinitrobenzene sulfonic acid colitis in mice. Gastroenterology. 2003 December; 125(6):1762-73. PMID: 14724829.

Hamer et al. Review article: the role of butyrate on colonic function. Aliment Pharmacol Ther. 2008 Jan. 15; 27(2): 104-19. PMID: 17973645.

Hammer et al. Spontaneous inflammatory disease in transgenic rats expressing HLA-B27 and human beta 2m: an animal model of HLA-B27-associated human disorders. Cell. 1990 Nov. 30; 63(5):1099-112. PMID: 2257626.

Hasegawa et al. Activation of a consensus FNR-dependent promoter by DNR of *Pseudomonas aeruginosa* in response to nitrite. FEMS Microbiol Lett. 1998 Sep. 15; 166(2):213-7. PMID: 9770276.

Hermiston M L, Gordon J I. Inflammatory bowel disease and adenomas in mice expressing a dominant negative N-cadherin. Science. 1995 Nov. 17; 270(5239):1203-7. PMID: 7502046.

Hetzel et al. Acryloyl-CoA reductase from *Clostridium propionicum*. An enzyme complex of propionyl-CoA dehydrogenase and electron-transferring flavoprotein. Eur J Biochem. 2003 March; 270(5):902-10. PMID: 12603323.

Hillman. Simple, rapid method for determination of propionic acid and other short-chain fatty acids in serum. Clin Chem. 1978 May; 24(5):800-3. PMID: 647915.

Hoeren et al. Sequence and expression of the gene encoding the respiratory nitrous-oxide reductase from *Paracoccus denitrificans*. New and conserved structural and regulatory motifs. Eur J Biochem. 1993 Nov. 15; 218(1):49-57. PMID: 8243476.

Hristodorov et al. Recombinant H22(scFv) blocks CD64 and prevents the capture of anti-TNF monoclonal antibody. A potential strategy to enhance anti-TNF therapy. MAbs. 2014; 6(5):1283-9. PMID: 25517313.

Hsu et al. Differential mechanisms in the pathogenesis of autoimmune cholangitis versus inflammatory bowel disease in interleukin-2Ralpha(−/−) mice. Hepatology. 2009 January; 49(1):133-40. PMID: 19065673.

Ianiro et al. Fecal microbiota transplantation in inflammatory bowel disease: beyond the excitement. Medicine (Baltimore). 2014 October; 93(19):e97. PMID: 25340496.

Isabella et al. Deep sequencing-based analysis of the anaerobic stimulon in *Neisseria gonorrhoeae*. BMC Genomics. 2011 Jan. 20; 12:51. PMID: 21251255.

Iyer S S, Cheng G. Role of interleukin 10 transcriptional regulation in inflammation and autoimmune disease. Crit Rev Immunol. 2012; 32(1):23-63. PMID: 22428854.

Johansson et al. The inner of the two Muc2 mucin-dependent mucus layers in colon is devoid of bacteria. Proc Natl Acad Sci USA. 2008 Sep. 30; 105(39):15064-9. PMID: 18806221.

Kanai et al. A breakthrough in probiotics: *Clostridium butyricum* regulates gut homeostasis and anti-inflammatory response in inflammatory bowel disease. J Gastroenterol. 2015 September; 50(9):928-39. PMID: 25940150.

Keates et al. TransKingdom RNA interference: a bacterial approach to challenges in RNAi therapy and delivery. Biotechnol Genet Eng Rev. 2008; 25:113-27. PMID: 21412352.

Khor B, Gardet A, Xavier R J. Genetics and pathogenesis of inflammatory bowel disease. Nature. 2011 Jun. 15; 474 (7351):307-17. PMID: 21677747.

Kleman et al. Acetate metabolism by *Escherichia coli* in high-cell-density fermentation. Appl Environ Microbiol. 1994 November; 60(11):3952-8. PMID: 7993084.

Lerner et al. (a) Changes in intestinal tight junction permeability associated with industrial food additives explain the rising incidence of autoimmune disease. Autoimmun Rev. 2015 June; 14(6):479-89. PMID: 25676324.

Lerner et al. (b) Rheumatoid arthritis-celiac disease relationship: Joints get that gut feeling. Autoimmun Rev. 2015 November; 14(11):1038-47. PMID: 26190704.

Low et al. Animal models of ulcerative colitis and their application in drug research. Drug Des Devel Ther. 2013 Nov. 12; 7:1341-57. PMID: 24250223.

Lukovac et al. Differential modulation by Akkermansia muciniphila and *Faecalibacterium prausnitzii* of host peripheral lipid metabolism and histone acetylation in mouse gut organoids. MBio. 2014 Aug. 12; 5(4). pii: e01438-14. PMID: 25118238.

MacPherson B R, Pfeiffer C J. Experimental production of diffuse colitis in rats. Digestion. 1978; 17(2):135-50. PMID: 627326.

Martinez et al. Deletion of Mtgr1 sensitizes the colonic epithelium to dextran sodium sulfate-induced colitis. Gastroenterology. 2006 August; 131(2):579-88. PMID: 16890610.

Matteoli et al. Gut CD103+ dendritic cells express indoleamine 2,3-dioxygenase which influences T regulatory/T effector cell balance and oral tolerance induction. Gut. 2010 May; 59(5):595-604. PMID: 20427394.

Meadow et al. Biosynthesis of diaminopimelic acid and lysine in *Escherichia coli*. Biochem J. 1959 July; 72(3): 396-400. PMID: 16748796.

Mizoguchi. Animal models of inflammatory bowel disease. Prog Mol Biol Transl Sci. 2012; 105:263-320. PMID: 22137435.

Mombaerts et al. Spontaneous development of inflammatory bowel disease in T cell receptor mutant mice. Cell. 1993 Oct. 22; 75(2):274-82. PMID: 8104709.

Moolenbeek C, Ruitenberg E J. The "Swiss roll": a simple technique for histological studies of the rodent intestine. Lab Anim. 1981 January; 15(1):57-9. PMID: 7022018.

Moore et al. Regulation of FNR dimerization by subunit charge repulsion. J Biol Chem. 2006 Nov. 3; 281(44): 33268-75. PMID: 16959764.

Morrissey et al. CD4+ T cells that express high levels of CD45RB induce wasting disease when transferred into congenic severe combined immunodeficient mice. Disease development is prevented by cotransfer of purified CD4+ T cells. J Exp Med. 1993 Jul. 1; 178(1):237-44. PMID: 8100269.

Mourelle et al. Polyunsaturated phosphatidylcholine prevents stricture formation in a rat model of colitis. Gastroenterology. 1996 April; 110(4):1093-7. PMID: 8612998.

Nguyen et al. Lymphocyte-dependent and Th2 cytokine-associated colitis in mice deficient in Wiskott-Aldrich syndrome protein. Gastroenterology. 2007 October; 133(4):1188-97. PMID: 17764675.

Nielsen. New strategies for treatment of inflammatory bowel disease. Front Med (Lausanne). 2014; 1:3. PMID: 25685754.

Nougayrede et al. *Escherichia coli* induces DNA double-strand breaks in eukaryotic cells. Science. 2006 Aug. 11; 313(5788):848-51. PMID: 16902142.

Ohman et al. Regression of Peyer's patches in G alpha i2 deficient mice prior to colitis is associated with reduced expression of Bcl-2 and increased apoptosis. Gut. 2002 September; 51(3):392-7. PMID: 12171962.

Okayasu et al. A novel method in the induction of reliable experimental acute and chronic ulcerative colitis in mice. Gastroenterology. 1990 March; 98(3):694-702. PMID: 1688816.

Olier et al. Genotoxicity of *Escherichia coli* Nissle 1917 strain cannot be dissociated from its probiotic activity. Gut Microbes. 2012 November-December; 3(6):501-9. PMID: 22895085.

Ostanin et al. T cell transfer model of chronic colitis: concepts, considerations, and tricks of the trade. Am J Physiol Gastrointest Liver Physiol. 2009 February; 296(2):G135-46. PMID: 19033538.

Paun et al. Immuno-ecology: how the microbiome regulates tolerance and autoimmunity. Curr Opin Immunol. 2015 Oct. 10; 37:34-9. PMID: 26460968.

Pizarro et al. SAMP1/YitFc mouse strain: a spontaneous model of Crohn's disease-like ileitis. Inflamm Bowel Dis. 2011 December; 17(12):2566-84. PMID: 21557393.

Powrie et al. Phenotypically distinct subsets of CD4+ T cells induce or protect from chronic intestinal inflammation in C. B-17 scid mice. Int Immunol. 1993 November; 5(11):1461-71. PMID: 7903159.

Pugsley. The complete general secretory pathway in gram-negative bacteria. Microbiol Rev. 1993 March; 57(1):50-108. PMID: 8096622.

Purcell et al. Towards a whole-cell modeling approach for synthetic biology. Chaos. 2013 June; 23(2):025112. PMID: 23822510.

Ragsdale. Enzymology of the wood-Ljungdahl pathway of acetogenesis. Ann N Y Acad Sci. 2008 March; 1125:129-36. PMID: 18378591.

Ray et al. The effects of mutation of the anr gene on the aerobic respiratory chain of *Pseudomonas aeruginosa*. FEMS Microbiol Lett. 1997 Nov. 15; 156(2):227-32. PMID: 9513270.

Reeves et al. Engineering *Escherichia coli* into a protein delivery system for mammalian cells. ACS Synth Biol. 2015; 4(5):644-54. PMID: 25853840.

Reister et al. Complete genome sequence of the Gram-negative probiotic *Escherichia coli* strain Nissle 1917. J Biotechnol. 2014 Oct. 10; 187:106-7. PMID: 25093936.

Rembacken et al. Non-pathogenic *Escherichia coli* versus mesalazine for the treatment of ulcerative colitis: a randomised trial. Lancet. 1999 Aug. 21; 354(9179):635-9. PMID: 10466665.

Remington's Pharmaceutical Sciences, $22^{nd}$ ed. Mack Publishing Co.

Rigel et al. A new twist on an old pathway—accessory Sec systems. Mol Microbiol. 2008 July; 69(2):291-302. PMID: 18544071.

Sabiu et al. Indomethacin-induced gastric ulceration in rats: Ameliorative roles of *Spondias mombin* and *Ficus exasperata*. Pharm Biol. 2016 January; 54(1):180-6. PMID: 25815713.

Saier. Protein secretion and membrane insertion systems in Gram-negative bacteria. J Membr Biol. 2006; 214(2):75-90. PMID: 17546510.

Salmon et al. Global gene expression profiling in *Escherichia coli* K12. The effects of oxygen availability and FNR. J Biol Chem. 2003 Aug. 8; 278(32):29837-55. PMID: 12754220.

Sanz et al. Microbiota, inflammation and obesity. Adv Exp Med Biol. 2014; 817:291-317. PMID: 24997040.

Sanz et al. Understanding the role of gut microbiome in metabolic disease risk. Pediatr Res. 2015 January; 77(1-2):236-44. PMID: 25314581.

Sat et al. The *Escherichia coli* mazEF suicide module mediates thymineless death. J Bacteriol. 2003 March; 185(6):1803-7. PMID: 12618443.

Satoh et al. New ulcerative colitis model induced by sulfhydryl blockers in rats and the effects of antiinflammatory drugs on the colitis. Jpn J Pharmacol. 1997 April; 73(4):299-309. PMID: 9165366.

Sawers. Identification and molecular characterization of a transcriptional regulator from *Pseudomonas aeruginosa* PAO1 exhibiting structural and functional similarity to the FNR protein of *Escherichia coli*. Mol Microbiol. 1991 June; 5(6):1469-81. PMID: 1787797.

Schiel-Bengelsdorf et al. Pathway engineering and synthetic biology using acetogens. FEBS Lett. 2012 Jul. 16; 586(15):2191-8. PMID: 22710156.

Schultz. Clinical use of *E. coli* Nissle 1917 in inflammatory bowel disease. Inflamm Bowel Dis. 2008 July; 14(7):1012-8. Review. PMID: 18240278.

Segui et al. Superoxide dismutase ameliorates TNBS-induced colitis by reducing oxidative stress, adhesion molecule expression, and leukocyte recruitment into the inflamed intestine. J Leukoc Biol. 2004 September; 76(3):537-44. PMID: 15197232.

Selmer et al. Propionate CoA-transferase from *Clostridium propionicum*. Cloning of gene and identification of glutamate 324 at the active site. Eur J Biochem. 2002 January; 269(1):372-80. PMID: 11784332.

Simpson et al. IBD: microbiota manipulation through diet and modified bacteria. Dig Dis. 2014; 32 Suppl 1:18-25. PMID: 25531349.

Smith et al. The microbial metabolites, short-chain fatty acids, regulate colonic Treg cell homeostasis. Science. 2013 Aug. 2; 341(6145):569-73. PMID: 23828891.

Sonnenborn et al. The non-pathogenic *Escherichia coli* strain Nissle 1917—features of a versatile probiotic. Microbial Ecology in Health and Disease. 2009; 21:122-58.

Stanley et al. Acute infection and macrophage subversion by *Mycobacterium tuberculosis* require a specialized secretion system. Proc Natl Acad Sci USA. 2003 October; 100(22):13001-6. PMID: 14557536.

Sugimoto et al. IL-22 ameliorates intestinal inflammation in a mouse model of ulcerative colitis. J Clin Invest. 2008 February; 118(2):534-44. PMID: 18172556.

Triantafillidis et al. Current and emerging drugs for the treatment of inflammatory bowel disease. Drug Des Devel Ther 5.5 (2011): 185-210.
Trunk et al. Anaerobic adaptation in *Pseudomonas aeruginosa*: definition of the Anr and Dnr regulons. Environ Microbiol. 2010 June; 12(6):1719-33. PMID: 20553552.
Tseng et al. Controlled biosynthesis of odd-chain fuels and chemicals via engineered modular metabolic pathways. Proc Natl Acad Sci USA. 2012 Oct. 30; 109(44):17925-30. PMID: 23071297.
Turski et al. Kynurenic Acid in the digestive system-new facts, new challenges. Int J Tryptophan Res. 2013 Sep. 4; 6:47-55. PMID: 24049450.
Ukena et al. Probiotic *Escherichia coli Nissle* 1917 inhibits leaky gut by enhancing mucosal integrity. PLoS One. 2007 Dec. 12; 2(12):e1308. PMID: 18074031.
Unden et al. Alternative respiratory pathways of *Escherichia coli*: energetics and transcriptional regulation in response to electron acceptors. Biochim Biophys Acta. 1997 Jul. 4; 1320(3):217-34. PMID: 9230919.
Varga et al. N-Methyl-D-aspartate receptor antagonism decreases motility and inflammatory activation in the early phase of acute experimental colitis in the rat. Neurogastroenterol Motil. 2010 February; 22(2):217-25. PMID: 19735360.
Wagner et al. Semisynthetic diet ameliorates Crohn's disease-like ileitis in INFΔARE/WT mice through antigen-independent mechanisms of gluten. Inflamm Bowel Dis. 2013 May; 19(6):1285-94. PMID: 23567784.
Watanabe et al. Interleukin 7 transgenic mice develop chronic colitis with decreased interleukin 7 protein accumulation in the colonic mucosa. J Exp Med. 1998 Feb. 2; 187(3):389-402. PMID: 9449719.
Wei et al. Mesenteric B cells centrally inhibit CD4+ T cell colitis through interaction with regulatory T cell subsets. Proc Natl Acad Sci USA. 2005 Feb. 8; 102(6):2010-15. PMID: 15684084.
Wen et al. Innate immunity and intestinal microbiota in the development of Type 1 diabetes. Nature. 2008 Oct. 23; 455(7216):1109-13. PMID: 18806780.
Whittem et al. Murine colitis modeling using dextran sulfate sodium (DSS). J Vis Exp. 2010 Jan. 19; (35). PMID: 20087313.
Wilk et al. The mdrla−/− mouse model of spontaneous colitis: a relevant and appropriate animal model to study inflammatory bowel disease. Immunol Res. 2005; 31(2): 151-9. PMID: 15778512.
Williams G T, Williams W J. Granulomatous inflammation—a review. J Clin Pathol. 1983 July; 36(7):723-733. PMID: 6345591.
Winteler et al. The homologous regulators ANR of *Pseudomonas aeruginosa* and FNR of *Escherichia coli* have overlapping but distinct specificities for anaerobically inducible promoters. Microbiology. 1996 March; 142 (Pt 3):685-93. PMID: 8868444.
Wolf et al. Overexpression of indoleamine 2,3-dioxygenase in human inflammatory bowel disease. Clin Immunol. 2004 October; 113(1):47-55. PMID: 15380529.
Wright et al. GeneGuard: A Modular Plasmid System Designed for Biosafety. ACS Synth Biol. 2015 Mar. 20; 4(3):307-16. PMID: 24847673.
Xiao et al. Nanoparticles with surface antibody against CD98 and carrying CD98 small interfering RNA reduce colitis in mice. Gastroenterology. 2014 May; 146(5): 1289-300. PMID: 24503126.
Yazbeck et al. Growth factor based therapies and intestinal disease: is glucagon-like peptide-2 the new way forward? Cytokine Growth Factor Rev. 2009 April; 20(2):175-84. PMID: 19324585.
Zhang et al. Deletion of interleukin-6 in mice with the dominant negative form of transforming growth factor beta receptor II improves colitis but exacerbates autoimmune cholangitis. Hepatology. 2010 July; 52(1):215-22. PMID: 20578264.
Zimmermann et al. Anaerobic growth and cyanide synthesis of *Pseudomonas aeruginosa* depend on anr, a regulatory gene homologous with fnr of *Escherichia coli*. Mol Microbiol. 1991 June; 5(6):1483-90. PMID: 1787798.

EXAMPLES

The following examples provide illustrative embodiments of the disclosure. One of ordinary skill in the art will recognize the numerous modifications and variations that may be performed without altering the spirit or scope of the disclosure. Such modifications and variations are encompassed within the scope of the disclosure. The Examples do not in any way limit the disclosure.

Example 1

Construction of Vectors for Producing Therapeutic Molecules

Butyrate
To facilitate inducible production of butyrate in *Escherichia coli* Nissle, the eight genes of the butyrate production pathway from *Peptoclostridium difficile* 630 (bcd2, etfB3, etfA3, thiA1, hbd, crt2, pbt, and buk; NCBI; Table 2 and Table 36), as well as transcriptional and translational elements, are synthesized (Gen9, Cambridge, Mass.) and cloned into vector pBR322 to create pLogic031 (bcd2-etfB3-etfA3-thiA1-hbd-crt2-pbt buk butyrate cassette, also referred to as bcd2-etfB3-etfA3 butyrate cassette, SEQ ID NO: 162).
The gene products of the bcd2-etfA3-etfB3 genes form a complex that converts crotonyl-CoA to butyryl-CoA and may exhibit dependence on oxygen as a co-oxidant. Because the recombinant bacteria of the invention are designed to produce butyrate in an oxygen-limited environment (e.g. the mammalian gut), that dependence on oxygen could have a negative effect of butyrate production in the gut. It has been shown that a single gene from *Treponema denticola*, trans-2-enoynl-CoA reductase (ter, Table 2 and Table 36), can functionally replace this three gene complex in an oxygen-independent manner. Therefore, a second butyrate gene cassette in which the ter gene replaces the bcd2-etfA3-etfB3 genes of the first butyrate cassette is synthesized (Genewiz, Cambridge, Mass.). The ter gene is codon-optimized for *E. coli* codon usage using Integrated DNA Technologies online codon optimization tool (https://www.idtdna.com/CodonOpt). The second butyrate gene cassette, as well as transcriptional and translational elements, is synthesized (Gen9, Cambridge, Mass.) and cloned into vector pBR322 to create pLogic046 (ter-thiA1-hbd-crt2-pbt buk butyrate cassette, also referred to herein as ter butyrate cassette or pbt buk butyrate cassette, SEQ ID NO: 163).
In a third butyrate gene cassette, the pbt and buk genes are replaced with tesB (SEQ ID NO: 10). TesB is a thioesterase found in *E. Coli* that cleaves off the butyrate from butyryl-coA, thus obviating the need for pbt-buk (see, e.g., FIG. 2 and Table 2 and Table 36). The third butyrate gene cassette, as well as transcriptional and translational elements, is synthesized (Gen9, Cambridge, Mass.) and cloned into vector pBR322 to create pLOGIC046-delta pbt.buk/tesB+ (ter-thiA1-hbd-crt2-tesb butyrate cassette, also referred to herein as tesB butyrate cassette, SEQ ID NO: 164). Table 36 lists non-limiting examples for sequences of the three cassettes.

TABLE 36

Butyrate Cassette Sequences

| Description | Sequence | SEQ ID NO |
|---|---|---|
| bcd2-etfB3-etfA3-thiA1-hb-crt2-pbt-buk butyrate cassette | atggatttaaattctaaaaaatatcagatgcttaaagagctatatgtaagcttcgctgaaaa tgaagttaaacctttagcaacagaacttgatgaagaagaaagatttccttatgaaacagt ggaaaaaatggcaaaagcaggaatgatgggtataccatatccaaaagaatatggtgg agaaggtggagacactgtaggatatataatggcagttgaagaattgtctagagtttgtgg tactacaggagttatattatcagctcatacatctcttggctcatggcctatatatcaatatgg taatgaagaacaaaaacaaaaattcttaagaccactagcaagtggagaaaaattagga gcatttggtcttactgagcctaatgctggtacagatgcgtctggccaacaaacaactgct gttttagacggggatgaatacatacttaatggctcaaaaatatttataacaaacgcaatag ctggtgacatatatgtagtaatggcaatgactgataaatctaaggggaacaaaggaata tcagcatttatagttgaaaaaggaactcctgggtttagctttggagttaaagaaaagaaa atgggtataagaggttcagctacgagtgaattaatatttgaggattgcagaatacctaaa gaaaatttacttggaaaagaaggtcaaggatttaagatagcaatgtctactcttgatggtg gtagaattggtatagctgcacaagcttaggtttagcacaaggtgctcttgatgaaactgt taaatatgtaaaagaaagagtacaatttggtagaccattatcaaaattccaaatacaca attccaattagctgatatggaagttaaggtacaagcggctagacaccttgtatatcaagc agctataaataaagacttaggaaaaccttatggagtagaagcagcaatggcaaaattat ttgcagctgaaacagctatggaagttactacaaaagctgtacaacttcatggaggatatg gatacactcgtgactatccagtagaaagaatgatgagagatgctaagataactgaaata tatgaaggaactagtgaagttcaaagaatggttatttcaggaaaactattaaaatagtaa gaaggagatatacatatggaggaaggatttatgaatatagtcgtttgtataaaacaagttc cagatacaacagaagttaaactagatcctaatacaggtactttaattagagatggagtac caagtataataaaccctgatgataaagcaggtttagaagaagctataaaattaaaagaa gaaatgggtgctcatgtaactgttataacaatgggacctcctcaagcagatatggctttta aagaagctttagcaatgggtgcagatagaggtatattattaacagatagagcatttgcg ggtgctgatacttgggcaacttcatcagcattagcaggagcattaaaaaatatagattttg atattataatagctggaagacaggcgtagatggagtactgcacaagttggacctcaa atagctgaacatttaaatcttccatcaataacatatgctgaagaaataaaaactgaaggtg aatatgtattagtaaaaagacaatttgaagattgttgccatgacttaaaagttaaaatgcca tgccttataacaactcttaaagatatgaacacaccaagatacatgaaagttggaagaata tatgatgctttcgaaaatgatgtagtagaaacatggactgtaaaagatatagaagttgac ccttctaatttaggtcttaaaggttctccaactagtgtatttaaatcatttacaaaatcagtta aaccagctggtacaatatacaatgaagatgcgaaaacatcagctggaattatcatagat aaattaaaagagaagtatatcatataataagaaggagatatacatatgggtaacgttttag tagtaatagaacaaagagaaaatgtaattcaaactgtttcttttagaattactaggaaaggc tacagaaatagcaaaagattatgatacaaaagtttctgcattacttttaggtagtaaggta gaaggtttaatagatacattagcacactatggtgcagatgaggtaatagtagtagatgat gaagctttagcagtgtatacaactgaaccatatacaaaagcagcttatgaagcaataaa agcagctgaccctatagttgtattatttggtgcaacttcaataggtagagatttagcgcct agagtttctgctagaatacatacaggtctttactgctgactgtacaggtcttgcagtagctg aagatacaaaattattattaatgacaagacctgcctttggtggaaatataatggcaacaat agtttgtaaagatttcagacctcaaatgtctacagttagaccaggggttatgaagaaaaa tgaacctgatgaaactaaagaagctgtaattaaccgtttcaaggtagaatttaatgatgct gataaattagttcaagttgtacaagtaataaaaagaagctaaaaaacaagttaaaatagaa gatgctaagatattagtttctgctggacgtggaatgggtggaaaagaaaacttagacata ctttatgaattagctgaaattataggtggagaagtttctggttctcgtgccactatagatgc aggttggttagataaagcaagacaagttggtcaaactggtaaaactgtaagaccagac ctttatatagcatgtggtatatctggagcaataacatatagctggtatggaagatgctg agtttatagttgctataaataaaaatccagaagctccaatatttaaatatgctgatgttgta tagttggagatgttcataaagtgcttccagaacttatcagtcagttaagtgttgcaaaaga aaaaggtgaagttttagctaactaataagaaggagatatacatatgagagaagtagtaat tgccagtgcagctagaacagcagtaggaagttttggaggtgcatttaaatcagttttcag cggtagagtaggggtaacagcagctaaagaagctataaaaagagctaacataactcc agatatgatagatgaatctcttttaggggagtacttacagcaggtcttggacaaaatata gcaagacaaatagcattaggagcaggaatacaagtagaaaaaccagctatgactataa atatagtttgtggttctggattaagatctgtttcaatggcatctcaacttatagctcattaggtg atgctgatataatgttagttggtggagctgaaaacatgagtatgtctccttatttagtacca agtgcgagatatggtgcaagaatgggtgatgctgcttttgttgattcaatgataaaagat ggattatcagacatatttaataactatcacatgggtattactgctgaaaacatagcagagc aatggaatataactagagaagaacaaagtgaattagctcttcgcaagtcaaaataaaagct gaaaaagctcaagctgaaggaaatttgatgaagaaatagttcctgttgttataaaagga agaaaaggtgacactgtagtagataaagatgaatatattaagcctggcactacaatgga gaaacttgctaagttaagacctgcatttaaaaagatggaacagttactgctggtaatgc atcaggaataaatgatggtgctgctatgttagtagtaatggctaaagaaaaagctgaag aactaggaatagagcctcttgcaactatagtttcttatggaacagctggtgttgaccctaa aataatgggatatgaccagttccagcaacaaaaagctttagaagctgctaatatga ctattgaagatatagatttagtgaagctaatgaggcatttgctgcccaatctgtagctgta ataagagacttaaatatagatatgaataaagtaatgttaatggtggagcaatagctatag gacatccaataggatgctcaggagcaagaatacttactacactttatatgaaatgaaga gaagagatgctaaaactggtcttgctacacactttgtataggcggtggaatgggaactactt | SEQ ID NO: 162 |

TABLE 36-continued

Butyrate Cassette Sequences

| Description | Sequence | SEQ ID NO |
|---|---|---|
| | taatagttaagagatagtaagaaggagatatacatatgaaattagctgtaataggtagtg gaactatgggaagtggtattgtacaaacttttgcaagttgtggacatgatgtatgtttaaa gagtagaactcaaggtgctatagataaatgtttagctttattagataaaaatttaactaagtt agttactaagggaaaaatggatgaagctacaaaagcagaaatattaagtcatgttagttc aactactaattatgaagatttaaaagatatggatttaataatagaagcatctgtagaagac atgaatataaagaaagatgttttcaagttactagatgaattatgtaaagaagatactatctt ggcaacaaatacttcatcattatctataacagaaatagcttcttctactaagcgcccagat aaagttataggaatgcatttctttaatccagttcctatgatgaaattagttgaagttataagt ggtcagttaacatcaaaagttacttttgatacagtatttgaattatctaagagtatcaataaa gtaccagtagatgtatctgaatctcctggatttgtagtaaatagaatacttatacctatgata aatgaagctgttggtatatatgcagatggtgttgcaagtaaagaagaaatagatgaagct atgaaattaggagcaaaccatccaatgggaccactagctcattggtgatttaatcggatta gatgttgttttagctataatgaacgttttatatactgaatttggagatactaaatatagacctc atccacttttagctaaaatggttagagctaatcaattaggaagaaaaactaagataggatt ctatgattataataaataataagaaggagatatacatatgagtacaagtgatgttaaagttt atgagaatgtagctgttgaagtagatggaaatatatgtacagtgaaaatgaatagaccta aagcccttaatgcaataaaattcaaagactttagaagaactttatgaagtatttgtagatatt aataatgatgaaactattgatgttgtaatattgacaggggaaggaaaggcatttgtagct ggagcagatattgcatacatgaaagatttagatgctgtagctgctaaagattttagtatctt aggagcaaaagcttttggagaaaatagaaaatagtaaaaaagtagtgatagctgctgta acggatttgctttaggtggaggatgtgaacttgcaatggcatgtgatataagaattgcatc tgctaaagctaaatttggtcagccagaagtaactcttggaataactccaggatatggag gaactcaaaggcttacaagattggttggaatggcaaaagcaaaagaattaatctttaca ggtcaagttataaaagctgatgaagctgaaaaaatagggctagtaatagagtcgttga gccagacattttaatagaagaagttgagaaattagctaagataatagctaaaaatgctca gcttgcagttagatactctaaagaagcaatacaacttggtgctcaaactgatataaatact ggaatagatatagaatctaatttatttggtctttgttttcaactaaagaccaaaagaagg aatgtcagctttcgttgaaaagagagaagctaactttataaaagggtaataagaaggag atatacatatgagaagttttgaagaagtaattaagtttgcaaaagaagaggacctaaaa ctatatcagtagcatgttgccaagataaaagaagttttaatgcagttgaaatggctagaa aagaaaaaatagcaaatgccattttagtaggagatatagaaaagactaaagaaattgca aaaagcatagacatggatatcgaaaattatgaactgatagatataaaagatttagcagaa gcatctctaaaatctgttgaattagtttcacaaggaaaagccgacatggtaatgaaaggc ttagtagacacatcaataatactaaaagcagttttaaataaagaagtaggtcttagaactg gaaatgtattaagtcacgtagcagtatttgatgtagagggatatgatagattatttttcgta actgacgcagctatgaacttagctcctgatacaaatactaaaaagcaaatcatagaaaat gcttgcacagtagcacattcattagatataagtgaaccaaaagttgctgcaatatgcgca aaagaaaaagtaaatccaaaaatgaaagatacagttgaagctaaagaactagaagaa atgtatgaagaggagaaatcaaaggttgtatggttggtgggcctttttgcaattgataat gcagtatctttagaagcagctaaacataaaggtataaatcatcctgtagcaggacgagc tgatatattattagccccagatattgaaggtggtaacatattatataaagctttggtattcttc tcaaaatcaaaaaatgcaggagttatagttggggctaaagcaccaataatattaacttct agagcagacagtgaagaaactaaactaaactcaatagctttaggtgttttaatggcagc aaaggcataataagaaggagatatacatatgagcaaaatatttaaaatcttaacaataaa tcctggttcgacatcaactaaaatagctgtatttgataatgaggatttagtatttgaaaaaa ctttaagacattcttcagaagaaataggaaaatgagaaggtgtctgaccaaatttgaatt tcgtaaacaagtaatagaagaagctctaaaagaaggtggagtaaaaacatctgaattag atgctgtagtaggtagaggaggacttcttaaacctataaaaggtggtacttattcagtaa gtgctgctatgattgaagatttaaaagtgggagtttttaggagaacacgcttcaaacctag gtggaataatagcaaaacaaataggtgaagaagtaaatgttcctcatcacatagtagac cctgttgttgtagatgaattagaagatgttgctagaatttctggtatgcctgaaataagtag agcaagtgtagtacatgctttaaatcaaaaggcaatagcaagaagatatgctagagaaa taaacaagaaatatgaagatataaatcttatagttgcacacatgggtggaggagtttctgt tggagctcataaaaatggtaaaatagtagatgttgcaaacgcattagatggagaaggac ctttctctccagaaagaagtggtggactaccagtaggtgcattagtaaaaatgtgctttag tggaaaatatactcaagatgaaattaaaagaaataaaaggtaatggcggactagttg catacttaaacactaatgatgctagagaagttgaagaaagaattgaagctggtgatgaa aaagctaaattagtatatgaagctatggcatatcaaatctctaaagaaataggagctagt gctgcagttcttaagggagatgtaaaagcaatattattaactggtggaatcgcatattcaa aaatgtttacagaaatgattgcagatagagttaaatttatgcagatgtaaaagtttatcca ggtgaagatgaaatgattgcattagctcaaggtggacttagagttttaactggtgaagaa gaggctcaagtttatgataactaataa | |
| ter-thiA1-hbd-crt2-pbt buk butyrate cassette | atgatcgtaaaacctatggtacgcaacaatatctgcctgaacgcccatcctcagggctg caagaagggagtggaagatcagattgaatataccaagaaacgcattaccgcagaagt caaagctggcgcaaaagctccaaaaaacgttctggtgcttggctgctcaaatgttacg gcctggcgagccgcattactgctgcgttcggatacggggctgcgaccatcggcgtgtc ctttgaaaaagcgggttcagaaaccaaatatggtacaccgggatggtacaataatttgg catttgatgaagcggcaaaacgcgagggtctttatagcgtgacgatcgacggcgatgc gttttcagacgagatcaaggcccaggtaattgaggaagccaaaaaaaaaggtatcaaa tttgatcgatcgtatacagcttggccagcccagtacgtactgatcctgatacaggtatca tgcacaaaagcgttttgaaacccttggaaaaacgttcacaggcaaaacagtagatccg tttactggcgagctgaaggaaatctccgcggaaccagcaaatgacgaggaagcagcc gccactgttaaagttatgggggtgaagattgggaacgttggattaagcagctgtcgaa ggaaggcctcttagaagaaggctgtattaccttggcctatagttatattggccctgaagc | SEQ ID NO: 163 |

TABLE 36-continued

Butyrate Cassette Sequences

| Description | Sequence | SEQ ID NO |
|---|---|---|
| | tacccaagctttgtaccgtaaaggcacaatcggcaaggccaaagaacacctggaggc cacagcacaccgtctcaacaaagagaacccgtcaatccgtgccttcgtgagcgtgaat aaaggcctggtaacccgcgcaagcgccgtaatcccggtaatccctctgtatctcgcca gcttgttcaaagtaatgaaagagaagggcaatcatgaaggttgtattgaacagatcacg cgtctgtacgccgagcgcctgtaccgtaaagatggtacaattccagttgatgaggaaaa tcgcattcgcattgatgattgggagttagaagaagacgtccagaaagcggtatccgcgt tgatggagaaagtcacggtgaaaacgcagaatctctcactgacttagcggggtaccg ccatgattcttagctagtaacggctttgatgtagaaggtattaattatgaagcggaagttg aacgcttcgaccgtatctgataagaaggagatatacatatgagagaagtagtaattgcc agtgcagctagaacagcagtaggaagttttggaggagcatttaaatcagtttcagcggt agagttaggggtaacagcagctaaagaagctataaaaagagctaacataactccagat atgatagatgaatctcttttaggggagtacttacagcaggtcttggacaaaatatagca agacaaatagcattaggagcaggaataccagtagaaaaaccagctatgactataaata tagtttgtggttctggattaagatctgtttcaatggcatctcaacttatagcattaggtgatg ctgatataatgttagttggtggagctgaaaacatgagtatgtctccttatttagtaccaagt gcgagatatggtgcaagaatgggtgatgctgcttttgttgattcaatgataaaagatgga ttatcagacatatttaataactatcacatgggtattactgctgaaaacatagcagagcaat ggaatataactagagaagaacaagatgaattagctcttgcaagtcaaaataaagctgaa aaagctcaagctgaaggaaaatttgatgaagaaatagttcctgttgttataaaaggaaga aaaggtgacactgtagtagataaagatgaatatattaagcctggcactacaatggagaa acttgctaagttaagacctgcatttaaaaaagatggaacagttactgctggtaatgcatca ggaataaatgatggtgctgctatgttagtagtaatggctaaagaaaaagctgaagaact aggaatagagcctcttgcaactatagtttcttatggaacagctggtgttgaccctaaaata atgggatatggaccagttccagcaactaaaaaagctttagaagctgctaatatgactatt gaagatatagatttagttgaagctaatgaggcatttgctgcccaatctgtagctgtaataa gagacttaaatatagatatgaataaagttaatgttaatggtggagcaatagctataggac atccaataggatgctcaggagcaagaatacttactacactttatatgaaatgaagagaa gagatgctaaaactggtcttgctcacactttgtataggcggtggaatgggaactactttaat agttaagagatagtaaggaggagatacatatgaaattagctgtaataggtagtggaa ctatgggaagtggtattgtacaaacttttgcaagttgtggacatgatgtatgtttaaagagt agaactcaaggtgctatagataaatgtttagctttattagataaaaaatttaactaagttagtt actaaggggaaaatggatgaagctacaaaagcagaaatattaagtcatgttagttcaac tactaattatgaagatttaaaagatatggatttaataataagaacatctgtagaagacatg aatataaagaaagatgtttcaagttactagatgaattatgtaaagaagatactatcttggc aacaaatacttcatcattatctataacagaaatagcttcttctactaagcgcccagataaa gttataggaatgcatttctttaatccagttcctatgatgaaattagttgaagttataagtggt cagttaacatcaaaagttacttttgatacagtatttgaattatctaagagtatcaataaagta ccagtagatgtatctgaatctcctggatttgtagtaaatagaatacttatacctatgataaat gaagctgttggtatatatgcagatggtgttgcaagtaaagaagaaatagatgaagctat gaaattaggagcaaaccatccaatgggaccactagcattaggtgatttaatcggattag atgttgttttagctataatgaacgttttatatactgaatttggagatactaaatatagaccctca tccactttagctaaaatggttagagctaatcaattaggaagaaaaactaagataggattc tatgattataataaataataagaaggagatatacatatgagtacaagtgatgttaaagttta tgagaatgtagctgttgaagtagatggaaatatatgtacagtgaaatgaatagaccctaa agcccttaatgcaataaattcaaagacttagaagaacttttatgaagtatttgtagatatta ataatgatgaaactattgatgttgtaatattgacaggggaaggaaaggcatttgtagctg gagcagatattgcatacatgaaagatttagatgctgtagctgctaaagatttttagtatctta ggagcaaaagcttttggagaaataaaaatagtaaaaaagtagtgatagctgctgtaaa cggatttgcttaggtggaggatgtgaacttgcaatggcatgtgatataagaattgcatct gctaaagctaaatttggtcagccagaagtaactcttggaataactccaggatatggagg aactcaaaggcttacaagattggttggaatggcaaaagcaaaagaattaatctttacag gtcaagttataaaagctgatgaagctgaaaaaatagggctagtaaatagagtcgttgag ccagacattttaatagaagaagttgagaaattagctaagataatagctaaaaatgctcag cttgcagttagatactctaaagaagcaataacaacttggtgctcaaactgatataaatactg gaatagatatagaatctaatttatttggtctttgttttttcaactaaagaccaaaaagaagga atgtcagctttcgttgaaaagagagaagctaactttataaagggtaataagaaggaga tatacatatgagaagttttgaagaagtaattaagtttgcaaaagaaagaggacctaaaac tatatcagtagcatgtgtgccaagataaaagaagttttttaatggcagttgaaatggctagaa agaaaaaatagcaaatgccattttagtaggagatatagaaaagactaaagaaattgcaa aaagcatagacatggatatcgaaaattatgaactgatagatataaaagatttagcagaa gcatctctaaaatctgttgaattagttttcacaaggaaaagccgacatggtaatgaaaggc ttagtagacacatcaataatactaaaagcagttttaaataaagaagtaggtcttagaactg gaaatgtattaagtcacgtagcagtatttgatgtagagggatatgatagattattttttcgta actgacgcagctatgaacttagctcctgatacaaatactaaaaagcaaatcatagaaaat gcttgcacagtagcacattcattagatataagtgaaccaaaagttgctgcaatatgcgca aaagaaaaagtaaatccaaaaatgaaagatacagttgaagctaaagaactagaagaa atgtatgaaagaggagaaatcaaaggttgtatggttggtgggcctttgcaattgataat gcagtatctttagaagcagctaaacataaaggtataaatcatcctgtagcaggacgagc tgatatattagcccagatattgaaggtggtaacatattatataaagctttggtattcttc tcaaaatcaaaaaatgcaggagttatagttggggctaaagccaataataattaacttct agagcagacagtgaagaaactaaactaaactcaatagctttaggtgtttaatggcagc aaaggcataataagaaggagatatacatatgagcaaaatatttaaaatcttaacaataaa tcctggttcgacatcaactaaaatagctgtatttgataatgaggatttagtatttgaaaaaa ctttaagacattcttcagaagaaataggaaaatatgagaaggtgtctgaccaatttgaatt tcgtaaacaagtaatagaagaagctctaaaagaaggtggagtaaaaacatctgaattag | |

TABLE 36-continued

Butyrate Cassette Sequences

| Description | Sequence | SEQ ID NO |
|---|---|---|
| | atgctgtagtaggtagaggaggacttcttaaacctataaaaggtggtacttattcagtaa<br>gtgctgctatgattgaagatttaaaagtgggagttttaggagaacacgcttcaaacctag<br>gtggaataatagcaaaacaaataggtgaagaagtaaatgttccttcatacatagtagac<br>cctgttgttgtagatgaattagaagatgttgctagaatttctggtatgcctgaaataagtag<br>agcaagtgtagtacatgctttaaatcaaaaggcaatagcaagaagatatgctagagaaa<br>taaacaagaaatatgaagatataaatcttatagttgcacacatgggtggaggagtttctgt<br>tggagctcataaaaatggtaaaatagtagatgttgcaaacgcattagatggagaaggac<br>cttttctctccagaaagaagtggtggactaccagtaggtgcattagtaaaaatgtgctttag<br>tggaaaatatactcaagatgaaattaaaaagaaaataaaaggtaatggcggactagttg<br>catacttaaacactaatgatgctagagaagttgaagaaagaattgaagctggtgatgaa<br>aaagctaaattagtatatgaagctatggcatatcaaatctctaaagaaataggagctagt<br>gctgcagttcttaagggagatgtaaaagcaatattattaactggtggaatcgcatattcaa<br>aaatgtttacagaaatgattgcagatagagttaaatttatagcagatgtaaaagtttatcca<br>ggtgaagatgaaatgattgcattagctcaaggtggacttagagttttaactggtgaagaa<br>gaggctcaagtttatgataactaataa | |
| ter-thiA1-hbd-<br>crt2-tesb<br>butyrate<br>cassette | atgatcgtaaaacctatggtacgcaacaatatctgcctgaacgcccatcctcagggctg<br>caagaagggagtggaagatcagattgaatataccaagaaacgcattaccgcagaagt<br>caaagctggcgcaaaagctccaaaaaacgttctggtgcttggctgctcaaatggttacg<br>gcctggcgagccgcattactgctgcgttcggatacggggcgtgcgaccatcggcgtgtc<br>ctttgaaaaagcgggttcagaaaccaaatatggtacaccgggatggtacaataatttgg<br>catttgatgaagcggcaaaacgcgagggtctttatagcgtgacgatcgacggcgatgc<br>gttttcagacgagatcaaggcccaggtaattgaggaagccaaaaaaaaaggtatcaaa<br>tttgatctgatcgtatacagcttggccagcccagtacgtactgtatcctgatacaggtatca<br>tgcacaaaagcgtttttgaaacccttggaaaaacgttcacaggcaaaacagtagatccg<br>tttactggcgagctgaaggaaatctccgcggaaccagcaaatgacgaggaagcagcc<br>gccactgttaaagttatgggggtgaagattgggaacgttggattaagcagctgtcgaa<br>ggaaggcctcttagaagaaggctgtattacctggcctatagttatattggccctgaagc<br>tacccaagctttgtaccgtaaaggcacaatcggcaaggccaaagaacacctggaggc<br>cacagcacaccgtctcaacaaagagaacccgtcaatccgtgccttcgtgagcgtgaat<br>aaaggcctggtaacccgcgcaagcgccgtaatcccggtaatccctctgtatctcgcca<br>gcttgttcaaagtaatgaaagagaagggcaatcatgaaggttgtattgaacagatcacg<br>cgtctgtacgccgagcgcctgtaccgtaaagatggtacaattccagttgatgaggaaaa<br>tcgcattcgcattgatgattgggagttagaagaagacgtccagaaagcggtatccgcgt<br>tgatggagaaagtcacgggtgaaaacgcagaatctctcactgacttagcggggtaccg<br>ccatgatttcttagctagtaacggctttgatgtagaaggtattaattatgaagcggaagttg<br>aacgcttcgaccgtatctgataagaaggagatatacatatgagagaagtagtaattgcc<br>agtgcagctagaacagcagtaggaagttttggaggagcatttaaatcagtttcagcggt<br>agagttaggggtaacagcagctaaagaagctataaaaagagctaacataactccagat<br>atgatagatgaatctcttttaggggggagtacttacagcaggtcttggacaaaatatagca<br>agacaaatagcattaggagcaggaataccagtagaaaaaccagctatgactataaata<br>tagtttgtggttctggattaagatctgtttcaatggcatctcaacttatagcattaggtgatg<br>ctgatataatgttagttggtggagctgaaaacatgagtatgtctccttatttagtaccaagt<br>gcgagatatggtgcaagaatgggtgatgctgcttttgttgattcaatgataaaagatgga<br>ttatcagacatatttaataactatcacatgggtattactgctgaaacatagcagagcaat<br>ggaatataactagagaagaacaagatgaattagctcttgcaagtcaaaatagaagctgaa<br>aaagctcaagctgaaggaaatttgatgaagaaatagttcctgttgttataaaaggaaga<br>aaaggtgacactgtagtagataaagatgaatatattaagcctggcactacaatggagaa<br>acttgctaagttaagacctgcatttaaaaaagatggaacagttactgctggtaatgcatca<br>ggaataaatgatggtgctgctatgttagtagtaatggctaaagaaaagctgaagaact<br>aggaatagagcctcttgcaactatagtttcttatggaacagctggtgttgaccctaaaata<br>atgggatatggaccagttccagcaactaaaaaagctttagaagctgctaatatgactatt<br>gaagatatagatttagttgaagctaatgaggcatttgctgcccaatctgtagctgtaataa<br>gagacttaaatatagatatgaataaagttaatgttaatgttggagcaatagctataggac<br>atccaataggatgctcaggagcaagaatacttactacacttttatatgaaatgaagagaa<br>gagatgctaaaactggtcttgctcactttgtataggcggtggaatgggaactactttaat<br>agttaagagatagtaagaaggagatatacatatgaaattagctgtaataggtagtggaa<br>ctatgggaagtggtattgtacaaacttttgcaagttgtgactgatgtatgtttaaagagt<br>agaactcaaggtgctatagataaatgttagctttattagataaaaatttaactaagttagtt<br>actaagggaaaaatggatgaagctacaaaagcagaaattaagtcatgttagttcaac<br>tactaattatgaagatttaaaagatatggatttaataatagaagcatctgtagaagacatg<br>aatataaagaaagatgttttcaagttactagatgaattatgtaaagaagatactatcttggc<br>aacaaatacttcatcattatctataacagaaatagcttcttctactaagcgcccagataaa<br>gttataggaatgcatttctttaatccagttcctatgatgaaattagttgaagttataagtggt<br>cagtaacatcaaaagttacttttgatacagtattgaattatctaagagtatcaataaagta<br>ccagtagatgtatctgaatctcctggatttgtagtaaatagaatacttatacctatgataaat<br>gaagctgttggtatatatgcagatggtgttgcaagtaaagaagaaatagatgaagctat<br>gaaattaggagcaaaccatccaatgggaccactagcattaggtgatttaatcggattag<br>atgttgttttagctataatgaacgttttatatactgaatttggagatactaaatatagacctca<br>tccacttttagctaaaatggttagagctaatcaattaggaagaaaaactaagataggattc<br>tatgattataataaataataagaaggagatatacatatgagtacaagtgatgttaaagttta<br>tgagaatgtagctgttgaagtagatgaaatatatgtacagtgaaatgaatagacctaa<br>agcccttaatgcaataaattcaaagactttagaagaactttatgaagtatttgtagatatta<br>ataatgatgaaactattgatgttgtaatattgacaggggaaggaaaggcatttgtagctg<br>gagcagatattgcatacatgaaagatttagatgctgtagctgctaaagatttagtatctta |  SEQ ID<br>NO: 164 |

TABLE 36-continued

Butyrate Cassette Sequences

| Description | Sequence | SEQ ID NO |
|---|---|---|
| | ggagcaaaagcttttggagaaatagaaaatagtaaaaaagtagtgatagctgctgtaaa<br>cggatttgctttaggtggaggatgtgaacttgcaatggcatgtgatataagaattgcatct<br>gctaaagctaaatttggtcagccagaagtaactcttggaataactccaggatatggagg<br>aactcaaaggcttacaagattggttggaatggcaaaagcaaaagaattaatctttacag<br>gtcaagttataaaagctgatgaagctgaaaaaatagggctagtaaatagagtcgttgag<br>ccagacattttaatagaagaagttgagaaattagctaagataatagctaaaaatgctcag<br>cttgcagttagatactctaaagaagcaatacaacttggtgctcaaactgatataaatactg<br>gaatagatatagaatctaatttatttggtctttgttttcaactaaagaccaaaaagaagga<br>atgtcagctttcgttgaaaagagagaagctaactttataaaagggtaataagaaggaga<br>tatacatatgAGTCAGGCGCTAAAAAATTTACTGACATTGT<br>TAAATCTGGAAAAAATTGAGGAAGGACTCTTTCGCG<br>GCCAGAGTGAAGATTTAGGTTTACGCCAGGTGTTTG<br>GCGGCCAGGTCGTGGGTCAGGCCTTGTATGCTGCAA<br>AAGAGACCGTCCCTGAAGAGCGGCTGGTACATTCGT<br>TTCACAGCTACTTTCTTCGCCCTGGCGATAGTAAGAA<br>GCCGATTATTTATGATGTCGAAACGCTGCGTGACGG<br>TAACAGCTTCAGCGCCCGCCGGGTTGCTGCTATTCA<br>AAACGGCAAACCGATTTTTTATATGACTGCCTCTTTC<br>CAGGCACCAGAAGCGGGTTTCGAACATCAAAAAAC<br>AATGCCGTCCGCGCCAGCGCCTGATGGCCTCCCTTC<br>GGAAACGCAAATCGCCCAATCGCTGGCGCACCTGCT<br>GCCGCCAGTGCTGAAAGATAAATTCATCTGCGATCG<br>TCCGCTGGAAGTCCGTCCGGTGGAGTTTCATAACCC<br>ACTGAAAGGTCACGTCGCAGAACCACATCGTCAGGT<br>GTGGATCCGCGCAAATGGTAGCGTGCCGGATGACCT<br>GCGCGTTCATCAGTATCTGCTCGGTTACGCTTCTGAT<br>CTTAACTTCCTGCCGGTAGCTCTACAGCCGCACGGC<br>ATCGGTTTTCTCGAACCGGGGATTCAGATTGCCACC<br>ATTGACCATTCCATGTGGTTCCATCGCCCGTTTAATT<br>TGAATGAATGGCTGCTGTATAGCGTGGAGAGCACCT<br>CGGCGTCCAGCGCACGTGGCTTTGTGCGCGGTGAGT<br>TTTATACCCAAGACGGCGTACTGGTTGCCTCGACCG<br>TTCAGGAAGGGGTGATGCGTAATCACAATtaa | |

In certain constructs, the butyrate gene cassette (e.g., bcd2-etfB3-etfA3-thiA1-hbd-crt2-pbt buk butyrate cassette (pLogic031), and/or ter-thiA1-hbd-crt2-pbt buk butyrate cassette (pLogic046) and/or ter-thiA1-hbd-crt2-tesb butyrate cassette (pLOGIC046-delta pbt.buk/tesB+)) is placed under the control of an RNS-responsive regulatory region, e.g., norB. In some embodiments, the butyrate gene cassette is placed under the control of an RNS-responsive regulatory region, e.g., norB. and the bacteria further comprises a gene encoding a corresponding RNS-responsive transcription factor, e.g., nsrR (see, e.g., Table 37 and Table 38 and SEQ ID NO: 167).

Table 37 depicts the nucleic acid sequence of an exemplary RNS-regulated construct comprising a gene encoding nsrR, a regulatory region of norB, and a butyrogenic gene cassette (pLogic031-nsrR-norB-butyrate construct; SEQ ID NO: 165). The sequence encoding NsrR is underlined and bolded, and the NsrR binding site, i.e., a regulatory region of norB is boxed . Table 38 depicts the nucleic acid sequence of an exemplary RNS-regulated construct comprising a gene encoding nsrR, a regulatory region of norB, and a butyrogenic gene cassette (pLogic046-nsrR-norB-butyrate construct; SEQ ID NO: 166). The sequence encoding NsrR is underlined and bolded, and the NsrR binding site, i.e., a regulatory region of norB is boxed .

Table 39 (SEQ ID NO: 167) depicts the nucleic acid sequence of an exemplary RNS-regulated construct comprising a gene encoding nsrR, a regulatory region of norB, and a butyrogenic gene cassette (pLOGIC046-delta pbt.buk/tesB+-nsrR-norB-butyrate construct (SEQ ID NO: 167).

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 165, 166, 167, or a functional fragment thereof.

TABLE 37

Nucleotide sequences of pLogic031-nsrR-norB-butyrate construct

Nucleotide sequences of pLogic031-nsrR-norB-butyrate construct (SEQ ID NO: 165)
ttatta<u>tcgcaccgcaatcgggattttcgattcataaagcaggtcgtaggtcggcttgtt</u>

<u>gagcaggtcttgcagcgtgaaaccgtccagatacgtgaaaaacgacttcattgcaccgcc</u>

<u>gagtatgcccgtcagccggcaggacggcgtaatcaggcattcgttgttcgggcccataca</u>

<u>ctcgaccagctgcatcggttcgaggtggcggacgaccgcgccgatattgatgcgttcggg</u>

<u>cggcgcggccagcctcagcccgccgcctttcccgcgtacgctgtgcaagaacccgcctt</u>

TABLE 37-continued

Nucleotide sequences of pLogic031-nsrR-norB-butyrate construct gaccagcgcggtaaccactttcatcaaatggcttttggaaatgccgtaggtcgaggcgat ggtggcgatattgaccagcgcgtcgtcgttgacggcggtgtagatgaggacgcgcagccc gtagtcggtatgttgggtcagatacatacaacctccttagtacatgcaaaattatttcta gagcaacatacgagccggaagcataaagtgtaaagcctggggtgcctaatgagttgagtt gaggaattataacaggaagaaatattcctcatacgcttgtaattcctctatggttgttga caattaatcatcggctcgtataatg[tataacattcatattttgtgaattttaaa]ctctag aaataattttgtttaactttaagaaggagatatacatatggatttaaattctaaaaaata tcagatgcttaaagagctatatgtaagcttcgctgaaaatgaagttaaacctttagcaac agaacttgatgaagaagaaagatttccttatgaaacagtggaaaaaatggcaaaagcagg aatgatgggtataccatatccaaaagaatatggtggagaaggtggagacactgtaggata tataatggcagttgaagaattgtctagagtttgtggtactacaggagttatattatcagc tcatacatctcttggctcatggcctatatatcaatatggtaatgaagaacaaaaacaaaa attcttaagaccactagcaagtggagaaaaattaggagcatttggtcttactgagcctaa tgctggtacagatgcgtctggccaacaaacaactgctgttttagacggggatgaatacat acttaatggctcaaaaatatttataacaaacgcaatagctggtgacatatatgtagtaat ggcaatgactgataaatctaaggggaacaaaggaatatcagcatttatagttgaaaaagg aactcctgggtttagctttggagttaaagaaaagaaatgggtataagaggttcagctac gagtgaattaatatttgaggattgcagaatacctaaagaaaatttacttggaaaagaagg tcaaggatttaagatagcaatgtctactcttgatggtggtagaattggtatagctgcaca agctttaggtttagcacaaggtgctcttgatgaaactgtttaaatatgtaaaagaaagagt acaatttggtagaccattatcaaaattccaaaatacacaattccaattagctgatatgga agttaaggtacaagcggctagacaccttgtatatcaagcagctataaataaagacttagg aaaaccttatggagtagaagcagcaatggcaaaattatttgcagctgaaacagctatgga agttactacaaaagctgtacaacttcatggaggatatggatacactcgtgactatccagt agaaagaatgatgagagatgctaagataactgaaatatatgaaggaactagtgaagttca aagaatggttatttcaggaaaactattaaaatagtaagaaggagatatacatatggagga aggatttatgaatatagtcgtttgtataaaacaagttccagatacaacagaagttaaact agatcctaatacaggtactttaattagagatggagtaccaagtataataaaccctgatga taaagcaggtttagaagaagctataaaattaaaagaagaaatgggtgctcatgtaactgt tataacaatgggacctcctcaagcagatatggctttaaaagaagctttagcaatgggtgc agatagaggtatattaacagatagagcatttgcgggtgctgatacttgggcaacttc atcagcattagcaggagcattaaaaaatatagattttgatattataatagctggaagaca ggcgatagatggagatactgcacaagttggaccctcaaatagctgaacatttaaatcttcc atcaataacatatgctgaagaaataaaaactgaaggtgaatatgtattagtaaaaagaca atttgaagattgttgccatgacttaaaagttaaaatgccatgccttataacaactcttaa agatatgaacacaccaagatacatgaaagttggaagaatatatgatgctttcgaaaatga tgtagtagaaacatggactgtaaaagatatagaagttgacccttctaatttaggtcttaa aggttctccaactagtgtatttaaatcatttacaaaatcagttaaaccagctggtacaat TABLE 37-continued Nucleotide sequences of pLogic031-nsrR-norB-butyrate construct atacaatgaagatgcgaaaacatcagctggaattatcatagataaattaaaagagaagta
tatcatataataagaaggagatatacatatgggtaacgttttagtagtaatagaacaaag
agaaaatgtaattcaaactgtttctttagaattactaggaaaggctacagaaatagcaaa
agattatgatacaaaagtttctgcattacttttaggtagtaaggtagaaggtttaataga
tacattagcacactatggtgcagatgaggtaatagtagtagatgatgaagctttagcagt
gtatacaactgaaccatatacaaaagcagcttatgaagcaataaaagcagctgaccctat
agttgtattatttggtgcaacttcaataggtagagatttagcgcctagagtttctgctag
aatacatacaggtcttactgctgactgtacaggtcttgcagtagctgaagatacaaaatt
attattaatgacaagacctgcctttggtggaaatataatggcaacaatagtttgtaaaga
tttcagacctcaaatgtctacagttagaccagggggttatgaagaaaaatgaacctgatga
aactaaagaagctgtaattaaccgtttcaaggtagaatttaatgatgctgataaattagt
tcaagttgtacaagtaataaaagaagctaaaaaacaagttaaaatagaagatgctaagat
attagtttctgctggacgtggaatgggtggaaaagaaaacttagacatactttatgaatt
agctgaaattataggtggagaagtttctggttctcgtgccactatagatgcaggttggtt
agataaagcaagacaagttggtcaaactggtaaaactgtaagaccagacctttatatagc
atgtggtatatctggagcaatacaacatatagctggtatggaagatgctgagtttatagt
tgctataaataaaaatccagaagctccaatatttaaatatgctgatgttggtatagttgg
agatgttcataaagtgcttccagaacttatcagtcagttaagtgttgcaaaagaaaaagg
tgaagttttagctaactaataagaaggagatatacatatgagagaagtagtaattgccag
tgcagctagaacagcagtaggaagttttggaggagcatttaaatcagtttcagcggtaga
gttaggggtaacagcagctaaagaagctataaaaagagctaacataactccagatatgat
agatgaatctcttttaggggggagtacttacagcaggtcttggacaaaatatagcaagaca
aatagcattaggagcaggaataccagtagaaaaaccagctatgactataaatatagtttg
tggttctggattaagatctgtttcaatggcatctcaacttatagcattaggtgatgctga
tataatgttagttggtggagctgaaaacatgagtatgtctccttatttagtaccaagtgc
gagatatggtgcaagaatgggtgatgctgcttttgttgattcaatgataaaagatggatt
atcagacatatttaataactatcacatgggtattactgctgaaaacatagcagagcaatg
gaatataactagagaagaacaagatgaattagctcttgcaagtcaaaataaagctgaaaa
agctcaagctgaaggaaaatttgatgaagaaatagttcctgttgttataaaaggaagaaa
aggtgacactgtagtagataaagatgaatatattaagcctggcactacaatggagaaact
tgctaagttaagacctgcatttaaaaaagatggaacagttactgctggtaatgcatcagg
aataaatgatggtgctgctatgttagtagtaatggctaaagaaaaagctgaagaactagg
aatagagcctcttgcaactatagtttcttatggaacagctggtgttgaccctaaaataat
gggatatggaccagttccagcaactaaaaaagctttagaagctgctaatatgactattga
agatatagatttagttgaagctaatgaggcatttgctgcccaatctgtagctgtaataag
agacttaaatatagatatgaataaagttaatgttaatggtggagcaatagctataggaca
tccaataggatgctcaggagcaagaatacttactacactttttatatgaaatgaagagaag
agatgctaaaactggtcttgctacactttgtataggcggtggaatgggaactactttaat TABLE 37-continued Nucleotide sequences of pLogic031-nsrR-norB-butyrate construct agttaagagatagtaagaaggagatatacatatgaaattagctgtaataggtagtggaac tatgggaagtggtattgtacaaacttttgcaagttgtggacatgatgtatgtttaaagag tagaactcaaggtgctatagataaatgtttagctttattagataaaaatttaactaagtt agttactaagggaaaaatggatgaagctacaaaagcagaaatattaagtcatgttagttc aactactaattatgaagatttaaaagatatggatttaataatagaagcatctgtagaaga catgaatataaagaaagatgttttcaagttactagatgaattatgtaaagaagatactat cttggcaacaaatacttcatcattatctataacagaaatagcttcttctactaagcgccc agataaagttataggaatgcatttctttaatccagttcctatgatgaaattagttgaagt tataagtggtcagttaacatcaaaagttacttttgatacagtatttgaattatctaagag tatcaataaagtaccagtagatgtatctgaatctcctggatttgtagtaaatagaatact tatacctatgataaatgaagctgttggtatatatgcagatggtgttgcaagtaaagaaga aatagatgaagctatgaaattaggagcaaaccatccaatgggaccactagcattaggtga tttaatcggattagatgttgtttagctataatgaacgttttatatactgaatttggaga tactaaatatagacctcatccacttttagctaaaatggttagagctaatcaattaggaag aaaaactaagataggattctatgattataataaataataagaaggagatatacatatgag tacaagtgatgttaaagtttatgagaatgtagctgttgaagtagatggaaatatatgtac agtgaaaatgaatagacctaaagcccttaatgcaataaattcaaagactttagaagaact ttatgaagtatttgtagatattaataatgatgaaactattgatgttgtaatattgacagg ggaaggaaaggcatttgtagctggagcagatattgcatacatgaaagatttagatgctgt agctgctaaagattttagtatcttaggagcaaaagcttttggagaaatagaaaatagtaa aaaagtagtgatagctgctgtaaacggatttgctttaggtggaggatgtgaacttgcaat ggcatgtgatataagaattgcatctgctaaagctaaatttggtcagccagaagtaactct tggaataactccaggatatggaggaactcaaaggcttacaagattggttggaatggcaaa agcaaaagaattaatctttacaggtcaagttataaaagctgatgaagctgaaaaaatagg gctagtaaatagagtcgttgagccagacatttaatagaagaagttgagaaattagctaa gataatagctaaaaatgctcagcttgcagttagatactctaaagaagcaatacaacttgg tgctcaaactgatataaatactggaatagatatagaatctaatttatttggtctttgttt ttcaactaaagaccaaaagaaggaatgtcagctttcgttgaaaagagagaagctaactt tataaagggtaataagaaggagatatacatatgagaagttttgaagaagtaattaagtt tgcaaaagaaagaggacctaaaactatatcagtagcatgttgccaagataaagaagtttt aatggcagttgaaatggctagaaaagaaaaaatagcaaatgccattttagtaggagatat agaaaagactaaagaaattgcaaaaagcatagacatggatatcgaaaattatgaactgat agatataaaagatttagcagaagcatctctaaaatctgttgaattagttttcacaaggaaa agccgacatggtaatgaaaggcttagtagacacatcaataatactaaaagcagttttaaa taaagaagtaggtcttagaactggaaatgtattaagtcacgtagcagtatttgatgtaga gggatatgatagattatttttcgtaactgacgcagctatgaacttagctcctgatacaaa tactaaaaagcaaatcatagaaaatgcttgcacagtagcacattcattagatataagtga accaaaagttgctgcaatatgcgcaaaagaaaaagtaaatccaaaaatgaaagatacagt tgaagctaaagaactagaagaaatgtatgaaagaggagaaatcaaaggttgtatggttgg

TABLE 37-continued

Nucleotide sequences of pLogic031-nsrR-norB-butyrate construct tgggccttttgcaattgataatgcagtatctttagaagcagctaaacataaaggtataaa tcatcctgtagcaggacgagctgatatattattagccccagatattgaaggtggtaacat attatataaagctttggtattcttctcaaaatcaaaaaatgcaggagttatagttggggc taaagcaccaataatattaacttctagagcagacagtgaagaaactaaactaaactcaat agctttaggtgttttaatggcagcaaaggcataataagaaggagatatacatatgagcaa aatatttaaaatcttaacaataaatcctggttcgacatcaactaaaatagctgtatttga taatgaggatttagtatttgaaaaaactttaagacattcttcagaagaaataggaaaata tgagaaggtgtctgaccaatttgaatttcgtaaacaagtaatagaagaagctctaaaaga aggtggagtaaaaacatctgaattagatgctgtagtaggtagaggaggacttcttaaacc tataaaaggtggtacttattcagtaagtgctgctatgattgaagatttaaaagtgggagt tttaggagaacacgcttcaaacctaggtggaataatagcaaaacaaataggtgaagaagt aaatgttccttcatacatagtagaccctgttgttgtagatgaattagaagatgttgctag aatttctggtatgcctgaaataagtagagcaagtgtagtacatgctttaaatcaaaaggc aatagcaagaagatatgctagagaaataaacaagaaatatgaagatataaatcttatagt tgcacacatgggtggaggagtttctgttggagctcataaaaatggtaaaatagtagatgt tgcaaacgcattagatggagaaggaccttttctctccagaaagaagtggtggactaccagt aggtgcattagtaaaaatgtgctttagtggaaaatatactcaagatgaaattaaaagaa aataaaaggtaatggcggactagttgcatacttaaacactaatgatgctagagaagttga agaaagaattgaagctggtgatgaaaaagctaaattagtatatgaagctatggcatatca aatctctaaagaaataggagctagtgctgcagttcttaagggagatgtaaaagcaatatt attaactggtggaatcgcatattcaaaaatgtttacagaaatgattgcagatagagttaa atttatagcagatgtaaaagtttatccaggtgaagatgaaatgattgcattagctcaagg tggacttagagttttaactggtgaagaagaggctcaagtttatgataactaataa

TABLE 38 pLogic046-nsrR-norB-butyrate construct

Nucleotide sequences of pLogic046-nsrR-norB-butyrate construct (SEQ ID NO: 166)
ttattatcgcaccgcaatcgggatttcgattcataaagcaggtcgtaggtcggcttgtt gagcaggtcttgcagcgtgaaaccgtccagatacgtgaaaaacgacttcattgcaccgcc gagtatgcccgtcagccggcaggacggcgtaatcaggcattcgttgttcgggcccataca ctcgaccagctgcatcggttcgaggtggcggacgaccgcgccgatattgatgcgttcggg cggcgcggccagcctcagcccgccgcctttcccgcgtacgctgtgcaagaacccgcctt gaccagcgcggtaaccactttcatcaaatggcttttggaaatgccgtaggtcgaggcgat ggtggcgatattgaccagcgcgtcgtcgttgacggcggtgtagatgaggacgcgcagccc gtagtcggtatgtgggtcagatacatacaacctccttagtacatgcaaaattatttcta gagcaacatacgagccggaagcataaagtgtaaagcctggggtgcctaatgagttgagtt gaggaattataacaggaagaaatattcctcatacgcttgtaattcctctatggttgttga TABLE 38-continued pLogic046-nsrR-norB-butyrate construct caattaatcatcggctcgtataatg|tataacattcatattttgtgaattttaaa|ctctag aaataattttgtttaactttaagaaggagatatacatatgatcgtaaaacctatggtacg caacaatatctgcctgaacgcccatcctcagggctgcaagaagggagtggaagatcagat tgaatataccaagaaacgcattaccgcagaagtcaaagctggcgcaaaagctccaaaaaa cgttctggtgcttggctgctcaaatggttacggcctggcgagccgcattactgctgcgtt cggatacggggctgcgaccatcggcgtgtcctttgaaaaagcgggttcagaaaccaaata tggtacaccgggatggtacaataatttggcatttgatgaagcggcaaaacgcgagggtct ttatagcgtgacgatcgacggcgatgcgttttcagacgagatcaaggcccaggtaattga ggaagccaaaaaaaaggtatcaaatttgatctgatcgtatacagcttggccagcccagt acgtactgatcctgatacaggtatcatgcacaaaagcgttttgaaacccttggaaaaac gttcacaggcaaaacagtagatccgtttactggcgagctgaaggaaatctccgcggaacc agcaaatgacgaggaagcagccgccactgttaaagttatgggggtgaagattgggaacg ttggattaagcagctgtcgaaggaaggcctcttagaagaaggctgtattaccttggccta tagttatattggccctgaagctacccaagctttgtaccgtaaaggcacaatcggcaaggc caaagaacacctggaggccacagcacaccgtctcaacaaagagaacccgtcaatccgtgc cttcgtgagcgtgaataaaggcctggtaacccgcgcaagcgccgtaatcccggtaatccc tctgtatctcgccagcttgttcaaagtaatgaaagagaagggcaatcatgaaggttgtat tgaacagatcacgcgtctgtacgccgagcgcctgtaccgtaaagatggtacaattccagt tgatgaggaaaatcgcattcgcattgatgattgggagttagaagaagacgtccagaaagc ggtatccgcgttgatggagaaagtcacgggtgaaaacgcagaatctctcactgacttagc ggggtaccgccatgatttcttagctagtaacggctttgatgtagaaggtattaattatga agcggaagttgaacgcttcgaccgtatctgataagaaggagatatacatatgagagaagt agtaattgccagtgcagctagaacagcagtaggaagttttggaggagcatttaaatcagt ttcagcggtagagttaggggtaacagcagctaaagaagctataaaaagagctaacataac tccagatatgatagatgaatctcttttaggggagtacttacagcaggtcttggacaaaa tatagcaagacaaatagcattaggagcaggaataccagtagaaaaaccagctatgactat aaatatagtttgtggttctggattaagatctgtttcaatggcatctcaacttatagcatt aggtgatgctgatataatgttagttggtggagctgaaaacatgagtatgtctccttattt agtaccaagtgcgagatatggtgcaagaatgggtgatgctgcttttgttgattcaatgat aaaagatggattatcagacatatttaataactatcacatgggtattactgctgaaaacat agcagagcaatggaatataactagagaagaacaagatgaattagctcttgcaagtcaaaa taaagctgaaaaagctcaagctgaaggaaaatttgatgaagaaatagttcctgttgttat aaaaggaagaaaaggtgacactgtagtagataaagatgaatatattaagcctggcactac aatggagaaacttgctaagttaagacctgcatttaaaaaagatggaacagttactgctgg taatgcatcaggaataaatgatggtgctgctatgttagtagtaatggctaaagaaaaagc tgaagaactaggaatagagcctcttgcaactatagtttcttatggaacagctggtgttga ccctaaaataatgggatatggaccagttccagcaactaaaaaagctttagaagctgctaa tatgactattgaagatatagatttagttgaagctaatgaggcatttgctgcccaatctgt agctgtaataagagacttaaatatagatatgaataaagttaatgttaatggtggagcaat TABLE 38-continued pLogic046-nsrR-norB-butyrate construct agctataggacatccaataggatgctcaggagcaagaatacttactacacttttatatga
atgaagagaagagatgctaaaactggtcttgctacactttgtataggcggtggaatggg
aactactttaatagttaagagatagtaagaaggagatatacatatgaaattagctgtaat
aggtagtggaactatgggaagtggtattgtacaaacttttgcaagttgtggacatgatgt
atgtttaaagagtagaactcaaggtgctatagataaatgtttagctttattagataaaaa
tttaactaagttagttactaagggaaaaatggatgaagctacaaaagcagaaatattaag
tcatgttagttcaactactaattatgaagatttaaaagatatggatttaataatagaagc
atctgtagaagacatgaatatagaagaaagatgttttcaagttactagatgaattatgtaa
agaagatactatcttggcaacaaatacttcatcattatctataacagaaatagcttcttc
tactaagcgcccagataaagttataggaatgcatttctttaatccagttcctatgatgaa
attagttgaagttataagtggtcagttaacatcaaaagttacttttgatacagtatttga
attatctaagagtatcaataaagtaccagtagatgtatctgaatctcctggatttgtagt
aaatagaatacttataccctatgataaatgaagctgttggtatatatgcagatggtgttgc
aagtaaagaagaaatagatgaagctatgaaattaggagcaaaccatccaatgggaccact
agcattaggtgatttaatcggattagatgttgttttagctataatgaacgttttatatac
tgaatttggagatactaaatatagacctcatccacttttagctaaaatggttagagctaa
tcaattaggaagaaaaactaagataggattctatgattataataaataataagaaggaga
tatacatatgagtacaagtgatgttaaagtttatgagaatgtagctgttgaagtagatgg
aaatatatgtacagtgaaaatgaatagacctaaagcccttaatgcaataaattcaaagac
tttagaagaactttatgaagtatttgtagatattaataatgatgaaactattgatgttgt
aatattgacaggggaaggaaaggcatttgtagctggagcagatattgcatacatgaaaga
tttagatgctgtagctgctaaagattttagtatcttaggagcaaaagcttttggagaaat
agaaaatagtaaaaagtagtgatagctgctgtaaacggatttgctttaggtggaggatg
tgaacttgcaatggcatgtgatataagaattgcatctgctaaagctaaatttggtcagcc
agaagtaactcttggaataactccaggatatggaggaactcaaaggcttacaagattggt
tggaatggcaaaagcaaaagaattaatctttacaggtcaagttataaaagctgatgaagc
tgaaaaaatagggctagtaaatagagtcgttgagccagacattttaatagaagaagttga
gaaattagctaagataatagctaaaaatgctcagcttgcagttagatactctaaagaagc
aatacaacttggtgctcaaactgatataaatactggaatagatatagaatctaatttatt
tggtctttgttttcaactaaagaccaaaaagaaggaatgtcagctttcgttgaaaagag
agaagctaactttataaaagggtaataagaaggagatatacatatgagaagttttgaaga
agtaattaagtttgcaaaagaaagaggacctaaaactatcagtagcatgttgccaaga
taaagaagttttaatggcagttgaaatggctagaaaagaaaaaatagcaaatgccatttt
agtaggagatatagaaaagactaaagaaattgcaaaaagcatagacatggatatcgaaaa
ttatgaactgatagatataaaagatttagcagaagcatctctaaaatctgttgaattagt
ttcacaaggaaaagccgacatggtaatgaaaggcttagtagacacatcaataatactaaa
agcagttttaaataaagaagtaggtcttagaactggaaatgtattaagtcacgtagcagt
atttgatgtagagggatatgatagattattttttcgtaactgacgcagctatgaacttagc
tcctgatacaaatactaaaaagcaaatcatagaaaatgcttgcacagtagcacattcatt

TABLE 38-continued pLogic046-nsrR-norB-butyrate construct agatataagtgaaccaaaagttgctgcaatatgcgcaaaagaaaaagtaaatccaaaaat
gaaagatacagttgaagctaaagaactagaagaaatgtatgaaagaggagaaatcaaagg
ttgtatggttggtgggccttttgcaattgataatgcagtatctttagaagcagctaaaca
taaaggtataaatcatcctgtagcaggacgagctgatatattattagccccagatattga
aggtggtaacatattatataaagctttggtattcttctcaaaatcaaaaaatgcaggagt
tatagttggggctaaagcaccaataatattaacttctagagcagacagtgaagaaactaa
actaaactcaatagctttaggtgttttaatggcagcaaaggcataataagaaggagatat
acatatgagcaaaatatttaaaatcttaacaataaatcctggttcgacatcaactaaaat
agctgtatttgataatgaggatttagtatttgaaaaaactttaagacattcttcagaaga
ataggaaaatatgagaaggtgtctgaccaatttgaatttcgtaaacaagtaatagaaga
agctctaaaagaaggtggagtaaaaacatctgaattagatgctgtagtaggtagaggagg
acttcttaaacctataaaaggtggtacttattcagtaagtgctgctatgattgaagattt
aaaagtgggagttttaggagaacacgcttcaaacctaggtggaataatagcaaaacaaat
aggtgaagaagtaaatgttccttcatacatagtagaccctgttgttgtagatgaattaga
agatgttgctagaatttctggtatgcctgaaataagtagagcaagtgtagtacatgctt
aaatcaaaaggcaatagcaagaagatatgctagagaaataaacaagaaatatgaagatat
aaatcttatagttgcacacatgggtggaggagtttctgttggagctcataaaaatggtaa
aatagtagatgttgcaaacgcattagatggagaaggaccttctctccagaaagaagtgg
tggactaccagtaggtgcattagtaaaaatgtgctttagtggaaaatatactcaagatga
aattaaaaagaaaataaaaggtaatggcggactagttgcatacttaaacactaatgatgc
tagagaagtgaagaaagaattgaagctggtgatgaaaaagctaaattagtatatgaagc
tatggcatatcaaatctctaaagaaataggagctagtgctgcagttcttaagggagatgt
aaaagcaatattattaactggtggaatcgcatattcaaaaatgtttacagaaatgattgc
agatagagttaaatttatagcagatgtaaaagtttatccaggtgaagatgaaatgattgc
attagctcaaggtggacttagagttttaactggtgaagaagaggctcaagtttatgataa
ctaataa

TABLE 39 pLOGIC046-delta pbt.buk/tesB+-nsrR-norB-butyrate construct
pLOGIC046-delta pbt.buk/tesB+-nsrR-norB-butyrate
construct SEQ ID NO: 167 ttatta<u>tcgcaccgcaatcgggattttcgattcataaagcaggtcgtaggtcggcttgtt</u>
<u>gagcaggtcttgcagcgtgaaaccgtccagatacgtgaaaaacgacttcattgcaccgcc</u>
<u>gagtatgcccgtcagccggcaggacggcgtaatcaggcattcgttgttcgggcccataca</u>
<u>ctcgaccagctgcatcggttcgaggtggcggacgaccgcgccgatattgatgcgttcggg</u>
<u>cggcgcggccagcctcagcccgccgcctttcccgcgtacgctgtgcaagaacccgcctt</u>
<u>gaccagcgcggtaaccactttcatcaaatggcttttggaaatgccgtaggtcgaggcgat</u>
<u>ggtggcgatattgaccagcgcgtcgtcgttgacggcggtgtagatgaggacgcgcagccc</u>
<u>gtagtcggtatgttgggtcagatacat</u>acaacctccttagtacatgcaaaattatttcta

TABLE 39-continued pLOGIC046-delta pbt.buk/tesB+-nsrR-norB-butyrate construct
pLOGIC046-delta pbt.buk/tesB+-nsrR-norB-butyrate
construct SEQ ID NO: 167 gagcaacatacgagccggaagcataaagtgtaaagcctggggtgcctaatgagttgagtt gaggaattataacaggaagaaatattcctcatacgcttgtaattcctctatggttgttga caattaatcatcggctcgtataatgtataacattcatattttgtgaattttaaactctag aaataattttgtttaactttaagaaggagatatacatatgatcgtaaaacctatggtacg caacaatatctgcctgaacgcccatcctcagggctgcaagaagggagtggaagatcagat tgaatataccaagaaacgcattaccgcagaagtcaaagctggcgcaaaagctccaaaaaa cgttctggtgcttggctgctcaaatggttacggcctggcgagccgcattactgctgcgtt cggatacggggctgcgaccatcggcgtgtcctttgaaaaagcgggttcagaaaccaaata tggtacaccgggatggtacaataatttggcatttgatgaagcggcaaaacgcgagggtct ttatagcgtgacgatcgacggcgatgcgttttcagacgagatcaaggcccaggtaattga ggaagccaaaaaaaaggtatcaaatttgatctgatcgtatacagcttggccagcccagt acgtactgatcctgatacaggtatcatgcacaaaagcgttttgaaacccttggaaaaac gttcacaggcaaaacagtagatccgtttactggcgagctgaaggaaatctccgcggaacc agcaaatgacgaggaagcagccgccactgttaaagttatgggggtgaagattgggaacg ttggattaagcagctgtcgaaggaaggcctcttagaagaaggctgtattaccttggccta tagttatattggccctgaagctacccaagctttgtaccgtaaaggcacaatcggcaaggc caaagaacacctggaggccacagcacaccgtctcaacaaagagaacccgtcaatccgtgc cttcgtgagcgtgaataaaggcctggtaacccgcgcaagcgccgtaatcccggtaatccc tctgtatctcgccagcttgttcaaagtaatgaaagagaagggcaatcatgaaggttgtat tgaacagatcacgcgtctgtacgccgagcgcctgtaccgtaaagatggtacaattccagt tgatgaggaaaatcgcattcgcattgatgattgggagttagaagaagacgtccagaaagc ggtatccgcgttgatggagaaagtcacgggtgaaaacgcagaatctctcactgacttagc ggggtaccgccatgatttcttagctagtaacggctttgatgtagaaggtattaattatga agcggaagttgaacgcttcgaccgtatctgataagaaggagatatacatatgagagaagt agtaattgccagtgcagctagaacagcagtaggaagttttggaggagcatttaaatcagt ttcagcggtagagttaggggtaacagcagctaaagaagctataaaaagagctaacataac tccagatatgatagatgaatctcttttaggggagtacttacagcaggtcttggacaaaa tatagcaagacaaatagcattaggagcaggaataccagtagaaaaaccagctatgactat aaatatagtttgtggttctggattaagatctgtttcaatggcatctcaacttatagcatt aggtgatgctgatataatgttagttggtggagctgaaaacatgagtatgtctccttattt agtaccaagtgcgagatatggtgcaagaatgggtgatgctgcttttgttgattcaatgat aaaagatggattatcagacatatttaataactatcacatgggtattactgctgaaaacat agcagagcaatggaatataactagagaagaacaagatgaattagctcttgcaagtcaaaa taaagctgaaaaagctcaagctgaaggaaaatttgatgaagaaatagttcctgttgttat aaaaggaagaaaaggtgacactgtagtagataaagatgaatatattaagcctggcactac aatggagaaacttgctaagttaagacctgcatttaaaaagatggaacagttactgctgg taatgcatcaggaataaatgatggtgctgctatgttagtagtaatggctaaagaaaaagc tgaagaactaggaatagagcctcttgcaactatagtttcttatggaacagctggtgttga TABLE 39-continued pLOGIC046-delta pbt.buk/tesB+-nsrR-norB-butyrate construct
pLOGIC046-delta pbt.buk/tesB+-nsrR-norB-butyrate
construct SEQ ID NO: 167 ccctaaaataatgggatatggaccagttccagcaactaaaaaagctttagaagctgctaa tatgactattgaagatatagatttagttgaagctaatgaggcatttgctgcccaatctgt agctgtaataagagacttaaatatagatatgaataaagttaatgttaatggtggagcaat agctataggacatccaataggatgctcaggagcaagaatacttactacactttttatatga aatgaagagaagagatgctaaaactggtcttgctacactttgtataggcggtggaatggg aactactttaatagttaagagatagtaagaaggagatatacatatgaaattagctgtaat aggtagtggaactatgggaagtggtattgtacaaacttttgcaagttgtggacatgatgt atgtttaaagagtagaactcaaggtgctatagataaatgtttagctttattagataaaaa tttaactaagttagttactaagggaaaaatggatgaagctacaaaagcagaaatattaag tcatgttagttcaactactaattatgaagatttaaaagatatggatttaataatagaagc atctgtagaagacatgaatataaagaaagatgttttcaagttactagatgaattatgtaa agaagatactatcttggcaacaaatacttcatcattatctataacagaaatagcttcttc tactaagcgcccagataaagttataggaatgcatttctttaatccagttcctatgatgaa attagttgaagttataagtggtcagttaacatcaaaagttacttttgatacagtatttga attatctaagagtatcaataaagtaccagtagatgtatctgaatctcctggatttgtagt aaatagaatacttatacctatgataaatgaagctgttggtatatatgcagatggtgttgc aagtaaagaagaaatagatgaagctatgaaattaggagcaaaccatccaatgggaccact agcattaggtgatttaatcggattagatgttgttttagctataatgaacgttttatatac tgaatttggagatactaaatatagacctcatccacttttagctaaaatggttagagctaa tcaattaggaagaaaaactaagataggattctatgattataataaataataagaaggaga tatacatatgagtacaagtgatgttaaagtttatgagaatgtagctgttgaagtagatgg aaatatgtacagtgaaaatgaatagacctaaagcccttaatgcaataaattcaaagac tttagaagaactttatgaagtatttgtagatattaataatgatgaaactattgatgttgt aatattgacaggggaaggaaaggcatttgtagctggagcagatattgcatacatgaaaga tttagatgctgtagctgctaaagattttagtatcttaggagcaaaagctttggagaaat agaaaatagtaaaaaagtagtgatagctgctgtaaacggatttgctttaggtggaggatg tgaacttgcaatggcatgtgatataagaattgcatctgctaaagctaaatttggtcagcc agaagtaactcttggaataactccaggatatggaggaactcaaaggcttacaagattggt tggaatggcaaaagcaaaagaattaatctttacaggtcaagttataaaagctgatgaagc tgaaaaaatagggctagtaaatagagtcgttgagccagacattttaatagaagaagttga gaaattagctaagataatagctaaaaatgctcagcttgcagttagatactctaaagaagc aatacaacttggtgctcaaactgatataaatactggaatagatatagaatctaatttatt tggtctttgtttttcaactaaagaccaaaaagaaggaatgtcagctttcgttgaaaagag agaagctaactttataaaagggtaataagaaggagatatacatatgAGTCAGGCGCTAAA

AAATTTACTGACATTGTTAAATCTGGAAAAAATTGAGGAAGGACTCTTTCGCGGCCAGAG

TGAAGATTTAGGTTTACGCCAGGTGTTTGGCGGCCAGGTCGTGGGTCAGGCCTTGTATGC

TGCAAAAGAGACCGTCCCTGAAGAGCGGCTGGTACATTCGTTTCACAGCTACTTTCTTCG

CCCTGGCGATAGTAAGAAGCCGATTATTTATGATGTCGAAACGCTGCGTGACGGTAACAG

TABLE 39-continued pLOGIC046-delta pbt.buk/tesB+-nsrR-norB-butyrate construct
pLOGIC046-delta pbt.buk/tesB+-nsrR-norB-butyrate
construct SEQ ID NO: 167

CTTCAGCGCCCGCCGGGTTGCTGCTATTCAAAACGGCAAACCGATTTTTTATATGACTGC

CTCTTTCCAGGCACCAGAAGCGGGTTTCGAACATCAAAAAACAATGCCGTCCGCGCCAGC

GCCTGATGGCCTCCCTTCGGAAACGCAAATCGCCCAATCGCTGGCGCACCTGCTGCCGCC

AGTGCTGAAAGATAAATTCATCTGCGATCGTCCGCTGGAAGTCCGTCCGGTGGAGTTTCA

TAACCCACTGAAAGGTCACGTCGCAGAACCACATCGTCAGGTGTGGATCCGCGCAAATGG

TAGCGTGCCGGATGACCTGCGCGTTCATCAGTATCTGCTCGGTTACGCTTCTGATCTTAA

CTTCCTGCCGGTAGCTCTACAGCCGCACGGCATCGGTTTTCTCGAACCGGGGATTCAGAT

TGCCACCATTGACCATTCCATGTGGTTCCATCGCCCGTTTAATTTGAATGAATGGCTGCT

GTATAGCGTGGAGAGCACCTCGGCGTCCAGCGCACGTGGCTTTGTGCGCGGTGAGTTTTA

TACCCAAGACGGCGTACTGGTTGCCTCGACCGTTCAGGAAGGGGTGATGCGTAATCACAA

Ttaa

In certain constructs, the butyrate gene cassette (e.g., bcd2-etfB3-etfA3-thiA1-hbd-crt2-pbt buk butyrate cassette (pLogic031), and/or ter-thiA1-hbd-crt2-pbt buk butyrate cassette (pLogic046) and/or ter-thiA1-hbd-crt2-tesb butyrate cassette (pLOGIC046-delta pbt.buk/tesB+)) is placed under the control of an ROS-responsive regulatory region, e.g., oxyS. In certain constructs, the butyrate gene cassette (e.g., bcd2-etfB3-etfA3-thiA1-hbd-crt2-pbt buk butyrate cassette (pLogic031), and/or ter-thiA1-hbd-crt2-pbt buk butyrate cassette (pLogic046) and/or ter-thiA1-hbd-crt2-tesb butyrate cassette (pLOGIC046-delta pbt.buk/tesB+)) is placed under the control of an ROS-responsive regulatory region, e.g., oxyS, and the bacteria further comprises a gene encoding a corresponding ROS-responsive transcription factor, e.g., oxyR (see, e.g., Table 28 and Table 29 and elsewhere herein).

Nucleic acid sequences of exemplary ROS-regulated constructs comprising an oxyS promoter are shown in Table 40 and Table 41 and Table 43. The nucleic acid sequence of an exemplary construct encoding OxyR is shown in Table 42. Table 40 depicts the nucleic acid sequence of an exemplary ROS-regulated construct comprising an oxyS promoter and a butyrogenic gene cassette (pLogic031-oxyS-butyrate construct; SEQ ID NO: 168). Table 41 depicts the nucleic acid sequence of an exemplary ROS-regulated construct comprising an oxyS promoter and a butyrogenic gene cassette (pLogic046-oxyS-butyrate construct; SEQ ID NO: 169). Table 42 depicts the nucleic acid sequence of an exemplary construct encoding OxyR (pZA22-oxyR construct; SEQ ID NO: 170). Table 43 depicts the nucleic acid sequence of an exemplary ROS-regulated construct comprising an oxyS promoter and a butyrogenic gene cassette (pLOGIC046-delta pbt.buk/tesB+-oxyS-butyrate construct; SEQ ID NO: 171).

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 168, 169, 170, or 171, or a functional fragment thereof.

TABLE 40 pLogic031-oxyS-butyrate construct (SEQ ID NO: 168)
Nucleotide sequences of pLogic031-oxyS-butyrate
construct (SEQ ID NO: 168)

ctcgagttcattatccatcctccatcgccacgatagttcatggcgatagg tagaatagcaatgaacgattatccctatcaagcattctgactgataattg ctcacacgaattcattaaagaggagaaaggtaccatggatttaaattcta aaaaatatcagatgcttaaagagctatatgtaagcttcgctgaaaatgaa gttaaaccttagcaacagaacttgatgaagaagaaagatttccttatga aacagtggaaaaaatggcaaaagcaggaatgatgggtataccatatccaa aagaatatggtggagaaggtggagacactgtaggatatataatggcagtt gaagaattgtctagagtttgtggtactacaggagttatattatcagctca tacatctcttggctcatggcctatatatcaatatggtaatgaagaacaaa aacaaaaattcttaagaccactagcaagtggagaaaaattaggagcattt ggtcttactgagcctaatgctggtacagatgcgtctggccaacaaacaac tgctgttttagacggggatgaatacatacttaatggctcaaaaatattta taacaaacgcaatagctggtgacatatatgtagtaatggcaatgactgat aaatctaagggaacaaaggaatatcagcatttatagttgaaaaaggaac tcctgggtttagctttggagttaaagaaaagaaaatgggtataagaggtt cagctacgagtgaattaatatttgaggattgcagaatacctaaagaaaat ttacttggaaaagaaggtcaaggatttaagatagcaatgtctactcttga tggtggtagaattggtatagctgcacaagctttaggtttagcacaaggtg ctcttgatgaaactgttaaatatgtaaaagaaagagtacaatttggtaga ccattatcaaaattccaaaatacacaattccaattagctgatatggaagt taaggtacaagcggctagacaccttgtatatcaagcagctataaataaag acttaggaaaacctttatggagtagaagcagcaatggcaaaattatttgca gctgaaacagctatggaagttactacaaaaagctgtacaacttcatggagg TABLE 40-continued pLogic031-oxyS-butyrate construct (SEQ ID NO: 168)
Nucleotide sequences of pLogic031-oxyS-butyrate
construct (SEQ ID NO: 168)

atatggatacactcgtgactatccagtagaaagaatgatgagagatgcta
agataactgaaatatatgaaggaactagtgaagttcaaagaatggttatt
tcaggaaaactattaaaatagtaagaaggagatatacatatggaggaagg
atttatgaatatagtcgtttgtataaaacaagttccagatacaacagaag
ttaaactagatcctaatacaggtactttaattagagatggagtaccaagt
ataataaaccctgatgataaagcaggtttagaagaagctataaaattaaa
agaagaaatgggtgctcatgtaactgttataacaatgggaccctcctcaag
cagatatggctttaaaagaagctttagcaatgggtgcagatagaggtata
ttattaacagatagagcatttgcgggtgctgatacttgggcaacttcatc
agcattagcaggagcattaaaaaatatagattttgatattataatagctg
gaagacaggcgatagatggagatactgcacaagttggacctcaaatagct
gaacatttaaatcttccatcaataacatatgctgaagaaataaaaactga
aggtgaatatgtattagtaaaaagacaatttgaagattgttgccatgact
taaaagttaaaatgccatgccttataacaactcttaaagatatgaacaca
ccaagatacatgaaagttggaagaatatatgatgctttcgaaaatgatgt
agtagaaacatggactgtaaaagatatagaagttgacccttctaatttag
gtcttaaaggttctccaactagtgtatttaaatcatttacaaaatcagtt
aaaccagctggtacaatatacaatgaagatgcgaaaacatcagctggaat
tatcatagataaattaaaagagaagtatatcataaatcataataagaaggagata
tacatatgggtaacgttttagtagtaatagaacaaagagaaaatgtaatt
caaactgtttctttagaattactaggaaaggctacagaaatagcaaaaga
ttatgatacaaaagtttctgcattacttttaggtagtaaggtagaaggtt
taatagatacattagcacactatggtgcagatgaggtaatagtagtagat
gatgaagctttagcagtgtatacaactgaaccatatacaaaagcagctta
tgaagcaataaaagcagctgaccctatagttgtatttttggtgcaactt
caataggtagagatttagcgcctagagtttctgctagaatacatacaggt
cttactgctgactgtacaggtcttgcagtagctgaagatacaaaattatt
attaatgacaagacctgcctttggtgaaatataatggcaacaatagttt
gtaaagatttcagacctcaaatgtctacagttagaccaggggttatgaag
aaaaatgaacctgatgaaactaaagaagctgtaattaaccgtttcaaggt
agaatttaatgatgctgataaattagttcaagttgtacaagtaataaaag
aagctaaaaacaagttaaaatagaagatgctaagatattagtttctgct
ggacgtggaatgggtggaaaagaaaacttagacatactttatgaattagc
tgaaattataggtggagaagtttctggttctcgtgccactatagatgcag
gttggttagataaagcaagacaagttggtcaaactggtaaaactgtaaga
ccagaccttaatagcatgtggtatatctggagcaatacaacatatagc
tggtatggaagatgctgagtttatagttgctataaataaaaatccagaag
ctccaatatttaaatatgctgatgttggtatagttggagatgttcataaa TABLE 40-continued pLogic031-oxyS-butyrate construct (SEQ ID NO: 168)
Nucleotide sequences of pLogic031-oxyS-butyrate
construct (SEQ ID NO: 168)

gtgcttccagaacttatcagtcagttaagtgttgcaaaagaaaaaggtga
agttttagctaactaataagaaggagatatacatatgagagaagtagtaa
ttgccagtgcagctagaacagcagtaggaagttttggaggagcatttaaa
tcagtttcagcggtagagttaggggtaacagcagctaaagaagctataaa
aagagctaacataactccagatatgatagatgaatctcttttaggggag
tacttacagcaggtcttggacaaaatatagcaagacaaatagcattagga
gcaggaataccagtagaaaaaccagctatgactataaatatagtttgtgg
ttctggattaagatctgtttcaatggcatctcaacttatagcattaggtg
atgctgatataatgttagttggtggagctgaaaacatgagtatgtctcct
tatttagtaccaagtgcgagatatggtgcaagaatgggtgatgctgcttt
tgttgattcaatgataaaagatggattatcagacatatttaataactatc
acatgggtattactgctgaaaacatagcagagcaatggaatataactaga
gaagaacaagatgaattagctcttgcaagtcaaaataaagctgaaaaagc
tcaagctgaaggaaaatttgatgaagaaatagttcctgttgttataaaag
gaagaaaggtgacactgtagtagataaagatgaatatattaagcctggc
actacaatggagaaacttgctaagttaagacctgcatttaaaaaagatgg
aacagttactgctggtaatgcatcaggaataaatgatggtgctgctatgt
tagtagtaatggctaaagaaaaagctgaagaactaggaatagagcctctt
gcaactatagtttcttatggaacagctggtgttgaccctaaaataatggg
atatggaccagttccagcaactaaaaaagctttagaagctgctaatatga
ctattgaagatatagatttagttgaagctaatgaggcatttgctgcccaa
tctgtagctgtaataagagactttaaatatagatatgaataaagttaatgt
taatggtggagcaatagctataggacatccaataggatgctcaggagcaa
gaatacttactacacttttatatgaaatgaagagaagagatgctaaaact
ggtcttgctacactttgtataggcggtggaatgggaactactttaatagt
taagagatagtaagaaggagatatacatatgaaattagctgtaataggta
gtggaactatgggaagtggtattgtacaaacttttgcaagttgtggacat
gatgtatgtttaaagagtagaactcaaggtgctatagataaatgtttagc
tttattagataaaaatttaactaagttagttactaagggaaaaatggatg
aagctacaaaagcagaaatattaagtcatgttagttcaactactaattat
gaagatttaaaagatatggatttaataatagaagcatctgtagaagacat
gaatataaagaaagatgttttcaagttactagatgaattatgtaaagaag
atactatcttggcaacaaatacttcatcattatctataacagaaatagct
tcttctactaagcgcccagataaagttataggaatgcatttctttaatcc
agttcctatgatgaaattagttgaagttataagtggtcagttaacatcaa
aagttacttttgatacagtatttgaattatctaagagtatcaataaagta
ccagtagatgtatctgaatctcctggatttgtagtaaatagaatacttat
acctatgataaatgaagctgttggtatatatgcagatggtgttgcaagta

TABLE 40-continued pLogic031-oxyS-butyrate construct (SEQ ID NO: 168)
Nucleotide sequences of pLogic031-oxyS-butyrate construct (SEQ ID NO: 168)

aagaagaaatagatgaagctatgaaattaggagcaaaccatccaatggga ccactagcattaggtgatttaatcggattagatgttgttttagctataat gaacgttttatatactgaatttggagatactaaatatagacctcatccac ttttagctaaaatggttagagctaatcaattaggaagaaaaactaagata ggattctatgattataataaataataagaaggagatatacatatgagtac aagtgatgttaaagtttatgagaatgtagctgttgaagtagatggaaata tatgtacagtgaaaatgaatagacctaaagcccttaatgcaataaattca aagactttagaagaactttatgaagtatttgtagatattaataatgatga aactattgatgttgtaatattgacaggggaaggaaaggcatttgtagctg gagcagatattgcatacatgaaagatttagatgctgtagctgctaaagat tttagtatcttaggagcaaaagcttttggagaaatagaaaatagtaaaaa agtagtgatagctgctgtaaacggatttgctttaggtggaggatgtgaac ttgcaatggcatgtgatataagaattgcatctgctaaagctaaatttggt cagccagaagtaactcttggaataactccaggatatggaggaactcaaag gcttacaagattggttggaatggcaaaagcaaaagaattaatctttacag gtcaagttataaaagctgatgaagctgaaaaaatagggctagtaaatga gtcgttgagccagacattttaatagaagaagttgagaaattagctaagat aatagctaaaaatgctcagcttgcagttagatactctaaagaagcaatac aacttggtgctcaaactgatataaatactggaatagatatagaatctaat ttatttggtctttgtttttcaactaaagaccaaaaagaaggaatgtcagc tttcgttgaaaagagagaagctaactttataaaagggtaataagaaggag atatacatatgagaagttttgaagaagtaattaagtttgcaaaagaaga ggacctaaaactatatcagtagcatgttgccaagataaagaagttttaat ggcagttgaaatggctagaaaagaaaaaatagcaaatgccattttagtag gagatatagaaaagactaaagaaattgcaaaaagcatagacatggatatc gaaaattatgaactgatagatataaaagatttagcagaagcatctctaaa atctgttgaattagtttcacaaggaaaagccgacatggtaatgaaaggct tagtagacacatcaataatactaaaagcagttttaaataaagaagtaggt cttagaactggaaatgtattaagtcacgtagcagtatttgatgtagaggg atatgatagattattttctgtaactgacgcagctatgaacttagctcctg atacaaatactaaaaagcaaatcatagaaaatgcttgcacagtagcacat tcattagatataagtgaaccaaaagttgctgcaatatgcgcaaaagaaaa agtaaatccaaaaatgaaagatacagttgaagctaaagaactagaagaaa tgtatgaagaggagaaatcaaaggttgtatggttggtgggccttttgca attgataatgcagtatcttagaagcagctaaacataaaggtataaatca tcctgtagcaggacgagctgatatattattagccccagatattgaaggtg taacatattatataaagctttggtattcttctcaaaatcaaaaaatgca ggagttatagttggggctaaagcaccaataatattaacttctagagcaga

TABLE 40-continued pLogic031-oxyS-butyrate construct (SEQ ID NO: 168)
Nucleotide sequences of pLogic031-oxyS-butyrate construct (SEQ ID NO: 168)

cagtgaagaaactaaactaaactcaatagctttaggtgtttaatggcag caaaggcataataagaaggagatatacatatgagcaaaatatttaaaatc ttaacaataaatcctggttcgacatcaactaaaatagctgtatttgataa tgaggatttagtatttgaaaaaactttaagacattcttcagaagaaatag gaaaatatgagaaggtgtctgaccaatttgaatttcgtaaacaagtaata gaagaagctctaaaagaaggtggagtaaaaacatctgaattagatgctgt agtaggtagaggaggacttcttaaacctataaaaggtggtacttattcag taagtgctgctatgattgaagatttaaaagtgggagttttaggagaacac gcttcaaacctaggtggaataatagcaaaacaaataggtgaagaagtaaa tgttccttcatacatagtagaccctgttgttgtagatgaattagaagatg ttgctagaatttctggtatgcctgaaataagtagagcaagtgtagtacat gctttaaatcaaaaggcaatagcaagaagatatgctagagaaataaacaa gaaatatgaagatataaatcttatagttgcacacatgggtggaggagttt ctgttggagctcataaaaatggtaaaatagtagatgttgcaaacgcatta gatggagaaggaccttctctctccagaaagaagtggtggactaccagtagg tgcattagtaaaaatgtgctttagtggaaaatatactcaagatgaaatta aaaagaaaataaaaggtaatggcggactagttgcatacttaaacactaat gatgctagagaagttgaagaaagaattgaagctggtgatgaaaaagctaa attagtatatgaagctatggcatatcaaatctctaaagaaataggagcta gtgctgcagttcttaagggagatgtaaaagcaatattattaactggtgga atcgcatattcaaaaatgtttacagaaatgattgcagatagagttaaatt tatagcagatgtaaaagtttatccaggtgaagatgaaatgattgcattag ctcaaggtggacttagagttttaactggtgaagaagaggctcaagtttat gataactaataa

TABLE 41 pLogic046-oxyS-butyrate construct (SEQ ID NO: 169)
Nucleotide sequences of pLogic046-oxyS-butyrate construct (SEQ ID NO: 169)

ctcgagttcattatccatcctccatcgccacgatagttcatggcgatagg tagaatagcaatgaacgattatccctatcaagcattctgactgataattg ctcacacgaattcattaaagaggagaaaggtaccatgatcgtaaaaccta tggtacgcaacaatatctgcctgaacgcccatcctcagggctgcaagaag ggagtggaagatcagattgaatataccaagaaacgcattaccgcagaagt caaagctggcgcaaaagctccaaaaaacgttctggtgcttggctgctcaa atggttacggcctggcgagccgcattactgctgcgttcggatacggggct gcgaccatcggcgtgtcctttgaaaaagcgggttcagaaaccaaatatgg tacaccgggatggtacaataatttggcatttgatgaagcggcaaaacgcg TABLE 41-continued pLogic046-oxyS-butyrate construct (SEQ ID NO: 169)
Nucleotide sequences of pLogic046-oxyS-butyrate
construct (SEQ ID NO: 169)

agggtctttatagcgtgacgatcgacggcgatgcgttttcagacgagatc aaggcccaggtaattgaggaagccaaaaaaaaggtatcaaatttgatct gatcgtatacagcttggccagcccagtacgtactgatcctgatacaggta tcatgcacaaaagcgttttgaaacccttttggaaaaacgttcacaggcaaa acagtagatccgtttactggcgagctgaaggaaatctccgcggaaccagc aaatgacgaggaagcagccgccactgttaaagttatgggggggtgaagatt gggaacgttggattaagcagctgtcgaaggaaggcctcttagaagaaggc tgtattccttggcctatagttatattggccctgaagctacccaagctttt gtaccgtaaaggcacaatcggcaaggccaaagaacacctggaggccacag cacaccgtctcaacaaagagaaccccgtcaatccgtgccttcgtgagcgtg aataaaggcctggtaacccgcgcaagcgccgtaatcccggtaatccctct gtatctcgccagcttgttcaaagtaatgaaagagaagggcaatcatgaag gttgtattgaacagatcacgcgtctgtacgccgagcgcctgtaccgtaaa gatggtacaattccagttgatgaggaaaatcgcattcgcattgatgattg ggagttagaagaagacgtccagaaagcggtatccgcgttgatggagaaag tcacgggtgaaaacgcagaatctctcactgacttagcgggggtaccgccat gatttcttagctagtaacggctttgatgtagaaggtattaattatgaagc ggaagttgaacgcttcgaccgtatctgataagaaggagatatacatatga gagaagtagtaattgccagtgcagctagaacagcagtaggaagttttgga ggagcatttaaatcagtttcagcggtagagttaggggtaacagcagctaa agaagctataaaaagagctaacataactccagatatgatagatgaatctc ttttaggggagtacttacagcaggtcttggacaaaatatagcaagacaa atagcattaggagcaggaataccagtagaaaaaccagctatgactataaa tatagtttgtggttctggattaagatctgtttcaatggcatctcaactta tagcattaggtgatgctgatataatgttagttggtggagctgaaaacatg agtatgtctccttatttagtaccaagtgcgagatatggtgcaagaatggg tgatgctgcttttgttgattcaatgataaaagatggattatcagacatat ttaataactatcacatgggtattactgctgaaaacatagcagagcaatgg aatataactagagaagaacaagatgaattagctcttgcaagtcaaaataa agctgaaaaagctcaagctgaaggaaaatttgatgaagaaatagttcctg ttgttataaaaggaagaaaaggtgacactgtagtagataaagatgaatat attaagcctggcactacaatggagaaacttgctaagttaagacctgcatt taaaaaagatggaacagttactgctggtaatgcatcaggaataaatgatg gtgctgctatgttagtagtaatggctaaagaaaaagctgaagaactagga atagagcctcttgcaactatagttcttatggaacagctggtgttgaccc taaaatgggatatggaccagttccagcaactaaaaaagctttagaag ctgctaatatgactattgaagatatagatttagttgaagctaatgaggca tttgctgcccaatctgtagctgtaataagagacttaaatatagatatgaa taaagttaatgttaatggtggagcaatagctataggacatccaataggat gctcaggagcaagaatacttactacacttttatatgaaatgaagagaaga gatgctaaaactggtcttgctacactttgtataggcggtggaatgggaac tactttaatagttaagagatagtaagaaggagatatacatatgaaattag ctgtaataggtagtggaactatgggaagtggtattgtacaacttttgca agttgtggacatgatgtatgtttaaagagtagaactcaaggtgctataga taaatgtttagctttattagataaaaatttaactaagttagttactaagg gaaaaatggatgaagctacaaaagcagaaatattaagtcatgttagttca actactaattatgaagatttaaaagatatggatttaataatagaagcatc tgtagaagacatgaatataaagaaagatgttttcaagttactagatgaat tatgtaaagaagatactatcttggcaacaaatacttcatcattatctata acagaaatagcttcttctactaagcgcccagataaagttataggaatgca tttctttaatccagttcctatgatgaaattagttgaagttataagtggtc agttaacatcaaaagttacttttttgatacagtatttgaattatctaagagt atcaataaagtaccagtagatgtatctgaatctcctggatttgtagtaaa tagaatacttatacctatgataaatgaagctgttggtatatatgcagatg gtgttgcaagtaaagaagaaatagatgaagctatgaaattaggagcaaac catccaatgggaccactagcattaggtgattttaatcggattagatgttgt tttagctataatgaacgttttatatactgaatttggagatactaaatata gacctcatccactttttagctaaaatggttagagctaatcaattaggaaga aaaactaagataggattctatgattataataaataataagaggagatat acatatgagtacaagtgatgttaaagtttatgagaatgtagctgttgaag tagatgaaatatatgtacagtgaaaatgaatagacctaaagcccttaat gcaataaattcaaagacttttagaagaactttatgaagtatttgtagatat taataatgatgaaactattgatgttgtaatattgacaggggaaggaaagg catttgtagctggagcagatattgcatacatgaaagatttagatgctgta gctgctaaagattttagtatcttaggagcaaaagcttttggagaaataga aaatagtaaaaagtagtgatagctgctgtaaacggatttgctttaggtg gaggatgtgaacttgcaatggcatgtgatataagaattgcatctgctaaa gctaaatttggtcagccagaagtaactcttggaataactccaggatatgg aggaactcaaaggcttacaagattggttggaatggcaaaagcaaaagaat taatctttacaggtcaagttataaaagctgatgaagctgaaaaaataggg ctagtaaatagagtcgttgagccagacattttaataagaagttgagaa attagctaagataatagctaaaaatgctcagcttgcagttagatactcta aagaagcaatacaacttggtgctcaaactgatataaatactggaatagat atagaatctaatttatttggtctttgttttttcaactaaagaccaaaaga aggaatgtcagctttcgttgaaaagagagaagctaacttttataaaagggt aataagaaggagatatacatatgagaagttttgaagaagtaattaagttt

TABLE 41-continued pLogic046-oxyS-butyrate construct (SEQ ID NO: 169)
Nucleotide sequences of pLogic046-oxyS-butyrate
construct (SEQ ID NO: 169)

gcaaaagaaagaggacctaaaactatatcagtagcatgttgccaagataa agaagttttaatggcagttgaaatggctagaaaagaaaaaatagcaaatg ccatttagtaggagatatagaaaagactaaagaaattgcaaaaagcata gacatggatatcgaaaattatgaactgatagatataaaagatttagcaga agcatctctaaaatctgttgaattagtttcacaaggaaaagccgacatgg taatgaaaggcttagtagacacatcaataatactaaaagcagttttaaat aaagaagtaggtcttagaactggaaatgtattaagtcacgtagcagtatt tgatgtagagggatatgatagattatttttcgtaactgacgcagctatga acttagctcctgatacaaatactaaaaagcaaatcatagaaaatgcttgc acagtagcacattcattagatataagtgaaccaaaagttgctgcaatatg cgcaaaagaaaaagtaaatccaaaaatgaaagatacagttgaagctaaag aactagaagaaatgtatgaaagaggagaaatcaaaggttgtatggttggt gggcctttgcaattgataatgcagtatctttagaagcagctaaacataa aggtataaatcatcctgtagcaggacgagctgatatattattagccccag atattgaaggtggtaacatattatataaagctttggtattcttctcaaaa tcaaaaaatgcaggagttatagttgggctaaagcaccaataatattaac ttctagagcagacagtgaagaaactaaactaaactcaatagctttaggtg ttttaatggcagcaaaggcataataagaaggagatatacatatgagcaaa atatttaaaatcttaacaataaatcctggttcgacatcaactaaaatagc tgtatttgataatgaggatttagtattgaaaaaacttttaagacattctt cagaagaaataggaaaaatatgagaaggtgtctgaccaatttgaatttcgt aaacaagtaatagaagaagctctaaaagaaggtgagtaaaaacatctga attagatgctgtagtaggtagaggaggacttcttaaacctataaaaggtg gtacttattcagtaagtgctgctatgattgaagatttaaaagtgggagtt ttaggagaacacgcttcaaacctaggtggaataatagcaaaacaaatagg tgaagaagtaaatgttccttcatacatagtagaccctgttgttgtagatg aattagaagatgttgctagaatttctggtatgcctgaaataagtagagca agtgtagtacatgctttaaatcaaaaggcaatagcaagaagatatgctag agaaataaacaagaaatatgaagatataaatcttatagttgcacacatgg gtggaggagtttctgttggagctcataaaaatggtaaaatagtagatgtt gcaaacgcattagatggagaaggaccttttctctccagaaagaagtggtgg actaccagtaggtgcattagtaaaaatgtgctttagtggaaaatatactc aagatgaaattaaaagaaaataaaaggtaatggcggactagttgcatac ttaaacactaatgatgctagagaagttgaagaaagaattgaagctggtga tgaaaaagctaaatttagtatatgaagctatggcatatcaaatctctaaag aaataggagctagtgctgcagttcttaaggggagatgtaaaagcaatatta ttaactggtggaatcgcatattcaaaaatgtttacagaaatgattgcaga tagagttaaatttatagcagatgtaaaagtttatccaggtgaagatgaaa

TABLE 41-continued pLogic046-oxyS-butyrate construct (SEQ ID NO: 169)
Nucleotide sequences of pLogic046-oxyS-butyrate
construct (SEQ ID NO: 169)

tgattgcattagctcaaggtggacttagagttttaactggtgaagaagag gctcaagtttatgataactaataa

TABLE 42 pZA22-oxyR construct (SEQ ID NO: 170)
Nucleotide sequences of pZA22-oxyR construct
(SEQ ID NO: 170)

ctcgagatgctagcaattgtgagcggataacaattgacattgtgagcgga taacaagatactgagcacatcagcaggacgcactgacccttaattaaaaga attcattaaagaggagaaaggtaccatgaatattcgtgatcttgagtacc tggtggcattggctgaacaccgccattttcggcgtgcggcagattcctgc cacgttagccagccgacgcttagcgggcaaattcgtaagctggaagatga gctgggcgtgatgttgctggagcggaccagccgtaaagtgttgttcaccc aggcgggaatgctgctggtggatcaggcgcgtaccgtgctgcgtgaggtg aaagtccttaaagagatggcaagccagcagggcgagacgatgtccggacc gctgcacattggtttgattcccacagttggaccgtacctgctaccgcata ttatccctatgctgcaccagacctttccaaagctggaaatgtatctgcat gaagcacagacccaccagttactggcgcaactggacagcggcaaactcga ttgcgtgatcctcgcgctggtgaaagagagcgaagcattcattgaagtgc cgttgtttgatgagccaatgttgctggctatctatgaagatcacccgtgg gcgaaccgcgaatgcgtaccgatggccgatctggcaggggaaaaactgct gatgctggaagatggtcactgtttgcgcgatcaggcaatgggtttctgtt ttgaagccggggcggatgaagatacacacttccgcgcgaccagcctggaa actctgcgcaacatggtggcggcaggtagcgggatcactttactgccagc gctggctgtgccgccggagcgcaaacgcgatgggggttgtttatctgccgt gcattaagccggaaccacgccgcactattggcctggtttatcgtcctggc tcaccgctgcgcagccgctatgagcagctggcagaggccatccgcgcaag aatggatggccatttcgataaagttttaaaacaggcggtttaaggatccc atggtacgcgtgctagaggcatcaaataaaacgaaaggctcagtcgaaag actgggcctttcgttttatctgttgtttgtcggtgaacgctctcctgagt aggacaaatccgccgccctagacctaggggatatattccgcttcctcgct cactgactcgctacgctcggtcgttcgactgcggcgagcggaaatggctt acgaacggggcggagatttcctggaagatgccaggaagatacttaacagg gaagtgagagggccgcggcaaagccgtttttccataggctccgcccccct gacaagcatcacgaaatctgacgctcaaatcagtggtggcgaaacccgac aggactataaagataccaggcgtttccccctggcggctccctcgtgcgct TABLE 42-continued pZA22-oxyR construct (SEQ ID NO: 170)
Nucleotide sequences of pZA22-oxyR construct
(SEQ ID NO: 170)

ctcctgttcctgcctttcggtttaccggtgtcattccgctgttatggccg cgtttgtctcattccacgcctgacactcagttccgggtaggcagttcgct ccaagctggactgtatgcacgaaccccccgttcagtccgaccgctgcgcc ttatccggtaactatcgtcttgagtccaacccggaaagacatgcaaaagc accactggcagcagccactggtaattgatttagaggagttagtcttgaag tcatgcgccggttaaggctaaactgaaaggacaagtttttggtgactgcgc tcctccaagccagttacctcggttcaaagagttggtagctcagagaacct tcgaaaaaccgccctgcaaggcggttttttcgttttcagagcaagagatt acgcgcagaccaaaacgatctcaagaagatcatcttattaatcagataaa atatttctagatttcagtgcaatttatctcttcaaatgtagcacctgaag tcagccccatacgatataagttgttactagtgcttggattctcaccaata aaaaacgcccggcggcaaccgagcgttctgaacaaatccagatggagttc tgaggtcattactggatctatcaacaggagtccaagcgagctctcgaacc ccagagtcccgctcagaagaactcgtcaagaaggcgatagaaggcgatgc gctgcgaatcgggagcggcgataccgtaaagcacgaggaagcggtcagcc cattcgccgccaagctcttcagcaatatcacgggtagccaacgctatgtc ctgatagcggtccgccacacccagccggccacagtcgatgaatccagaaa agcggccattttccaccatgatattcggcaagcaggcatcgccatgggtc acgacgagatcctcgccgtcgggcatgcgcgccttgagcctggcgaacag ttcggctggcgcgagcccctgatgctcttcgtccagatcatcctgatcga caagaccggcttccatccgagtacgtgctcgctcgatgcgatgtttcgct tggtggtcgaatgggcaggtagccggatcaagcgtatgcagccgccgcat tgcatcagccatgatggatactttctcggcaggagcaaggtgagatgaca ggagatcctgccccggcacttcgcccaatagcagccagtcccttcccgct tcagtgacaacgtcgagcacagctgcgcaaggaacgcccgtcgtggccag ccacgatagccgcgctgcctcgtcctgcagttcattcagggcaccggaca ggtcggtcttgacaaaaagaaccgggcgcccctgcgctgacagccggaac acggcggcatcagagcagccgattgtctgttgtgcccagtcatagccgaa tagcctctccacccaagcggccggagaacctgcgtgcaatccatcttgtt caatcatgcgaaacgatcctcatcctgtctcttgatcagatcttgatccc ctgcgccatcagatccttggcggcaagaaagccatccagtttactttgca gggcttcccaaccttaccagagggcgcccagctggcaattccgacgtct aagaaaccattattatcatgacattaacctataaaaataggcgtatcacg aggcccttttcgtcttcac

TABLE 43 pLOGIC046-delta pbt.buk/tesB+-oxyS-butyrate
construct
Nucleotide sequences of pLOGIC046-delta pbt.buk/
tesB+-oxyS-butyrate construct
(SEQ ID NO: 171)

Ctcgagttcattatccatcctccatcgccacgatagttcatggcgatagg tagaatagcaatgaacgattatccctatcaagcattctgactgataattg ctcacacgaattcattaaagaggagaaaggtaccatgatcgtaaaaccta tggtacgcaacaatatctgcctgaacgccatcctcagggctgcaagaag ggagtggaagatcagattgaatataccaagaaacgcattaccgcagaagt caaagctggcgcaaaagctccaaaaaacgttctggtgcttggctgctcaa atggttacggcctggcgagccgcattactgctgcgttcggatacggggct gcgaccatcggcgtgtcctttgaaaaagcgggttcagaaaccaaatatgg tacaccgggatggtacaataatttggcatttgatgaagcggcaaaacgcg agggtctttatagcgtgacgatcgacggcgatgcgttttcagacgagatc aaggcccaggtaattgaggaagccaaaaaaaaaggtatcaaatttgatct gatcgtatacagcttggccagcccagtacgtactgatcctgatacaggta tcatgcacaaaagcgttttgaaacccttggaaaaacgttcacaggcaaa acagtagatccgtttactggcgagctgaaggaaatctccgcggaaccagc aaatgacgaggaagcagccgccactgttaaagttatggggggtgaagatt gggaacgttggattaagcagctgtcgaaggaaggcctcttagaagaaggc tgtattaccttggcctatagttatattggccctgaagctacccaagctttt gtaccgtaaaggcacaatcggcaaggccaaagaacacctggaggccacag cacaccgtctcaacaaagagaacccgtcaatccgtgccttcgtgagcgtg aataaaggcctggtaacccgcgcaagcgccgtaatcccggtaatccctct gtatctcgccagcttgttcaaagtaatgaaagagaagggcaatcatgaag gttgtattgaacagatcacgcgtctgtacgccgagcgcctgtaccgtaaa gatggtacaattccagttgatgaggaaaatcgcattcgcattgatgattg ggagttagaagaagacgtccagaaagcggtatccgcgttgatggagaaag tcacgggtgaaaacgcagaatctctcactgacttagcggggtaccgccat gatttcttagctagtaacggctttgatgtagaaggtattaattatgaagc ggaagttgaacgcttcgaccgtatctgataagaaggagatatacatatga gagaagtagtaattgccagtgcagctagaacagcagtaggaagttttgga ggagcatttaaatcagtttcagcggtagagttaggggtaacagcagctaa agaagctataaaaagagctaacataactccagatatgatagatgaatctc ttttaggggagtacttacagcaggtcttggacaaaatatagcaagacaa atagcattaggagcaggaataccagtagaaaaaccagctatgactataaa tatagtttgtggttctggattaagatctgtttcaatggcatctcaactta tagcattaggtgatgctgataatgttagttggtggagctgaaaacatg agtatgtctccttatttagtaccaagtgcgagatatggtgcaagaatggg tgatgctgcttttgttgattcaatgataaaagatggattatcagacatat ttaataactatcacatgggtattactgctgaaaacatagcagagcaatgg

TABLE 43-continued pLOGIC046-delta pbt.buk/tesB+-oxyS-butyrate construct
Nucleotide sequences of pLOGIC046-delta pbt.buk/tesB+-oxyS-butyrate construct
(SEQ ID NO: 171)

aatataactagagaagaacaagatgaattagctcttgcaagtcaaaataa agctgaaaaagctcaagctgaaggaaaatttgatgaagaaatagttcctg ttgttataaaaggaagaaaaggtgacactgtagtagataaagatgaatat attaagcctggcactacaatggagaaacttgctaagttaagacctgcatt taaaaaagatggaacagttactgctggtaatgcatcaggaataaatgatg gtgctgctatgttagtagtaatggctaaagaaaaagctgaagaactagga atagagcctcttgcaactatagtttcttatggaacagctggtgttgaccc taaaataatgggatatggaccagttccagcaactaaaaaagctttagaag ctgctaatatgactattgaagatatagatttagttgaagctaatgaggca tttgctgcccaatctgtagctgtaataagagacttaaatatagatatgaa taaagttaatgttaatggtggagcaatagctataggacatccaataggat gctcaggagcaagaatacttactacacttttatatgaaatgaagagaaga gatgctaaaactggtcttgctacactttgtataggcggtggaatgggaac tactttaatagttaagagatagtaagaaggagatatacatatgaaattag ctgtaataggtagtggaactatgggaagtggtattgtacaaacttttgca agttgtggacatgatgtatgtttaaagagtagaactcaaggtgctataga taaatgtttagctttattagataaaaatttaactaagttagttactaagg gaaaaatggatgaagctacaaaagcagaaatattaagtcatgttagttca actactaattatgaagatttaaaagatatggatttaataatagaagcatc tgtagaagacatgaatataaagaaagatgttttcaagttactagatgaat tatgtaaagaagatactatcttggcaacaaatacttcatcattatctata acagaaatagcttcttctactaagcgcccagataaagttataggaatgca tttctttaatccagttcctatgatgaaattagttgaagttataagtggtc agttaacatcaaaagttacttttgatacagtatttgaattatctaagagt atcaataaagtaccagtagatgtatctgaatctcctggatttgtagtaaa tagaatacttatacctatgataaatgaagctgttggtatatatgcagatg gtgttgcaagtaaagaagaaatagatgaagctatgaaattaggagcaaac catccaatgggaccactagcattaggtgatttaatcggattagatgttgt tttagctataatgaacgttttatatactgaatttggagatactaaatata gacctcatccactttttagctaaaatggttagagctaatcaattaggaaga aaaactaagataggattctatgattataataaataataagaaggagatat acatatgagtacaagtgatgttaaagtttatgagaatgtagctgttgaag tagatggaaatatatgtacagtgaaaatgaatagacctaaagcccttaat gcaataaattcaaagactttagaagaactttatgaagtatttgtagatat taataatgatgaaactattgatgttgtaatattgacagggaaggaaagg catttgtagctggagcagatattgcatacatgaaagatttagatgctgta gctgctaaagattttagtatcttaggagcaaaagcttttggagaaataga aaatagtaaaaaagtagtgatagctgctgtaaacggatttgctttaggtg gaggatgtgaacttgcaatggcatgtgatataagaattgcatctgctaaa gctaaatttggtcagccagaagtaactcttggaataactccaggatatgg aggaactcaaaggcttacaagattggttggaatggcaaaagcaaaagaat taatctttacaggtcaagttataaaagctgatgaagctgaaaaaatag gg ctagtaaatagagtcgttgagccagacattttaatagaagaagttgagaa attagctaagataatagctaaaaatgctcagcttgcagttagatactcta aagaagcaatacaacttggtgctcaaactgatataaatactggaatagat atagaatctaatttatttggtctttgttttcaactaaagaccaaaaaga aggaatgtcagctttcgttgaaaagagagaagctaactttataaaagggt aataagaaggagatatacatatgAGTCAGGCGCTAAAAAATTTACTGACA

TTGTTAAATCTGGAAAAAATTGAGGAAGGACTCTTTCGCGGCCAGAGTGA

AGATTTAGGTTTACGCCAGGTGTTTGGCGGCCAGGTCGTGGGTCAGGCCT

TGTATGCTGCAAAAGAGACCGTCCCTGAAGAGCGGCTGGTACATTCGTTT

CACAGCTACTTTCTTCGCCCTGGCGATAGTAAGAAGCCGATTATTTATGA

TGTCGAAACGCTGCGTGACGGTAACAGCTTCAGCGCCCGCCGGGTTGCTG

CTATTCAAAACGGCAAACCGATTTTTTATATGACTGCCTCTTTCCAGGCA

CCAGAAGCGGGTTTCGAACATCAAAAAACAATGCCGTCCGCGCCAGCGCC

TGATGGCCTCCCTTCGGAAACGCAAATCGCCCAATCGCTGGCGCACCTGC

TGCCGCCAGTGCTGAAAGATAAATTCATCTGCGATCGTCCGCTGGAAGTC

CGTCCGGTGGAGTTTCATAACCCACTGAAAGGTCACGTCGCAGAACCACA

TCGTCAGGTGTGGATCCGCGCAAATGGTAGCGTGCCGGATGACCTGCGCG

TTCATCAGTATCTGCTCGGTTACGCTTCTGATCTTAACTTCCTGCCGGTA

GCTCTACAGCCGCACGGCATCGGTTTTCTCGAACCGGGGATTCAGATTGC

CACCATTGACCATTCCATGTGGTTCCATCGCCCGTTTAATTTGAATGAAT

GGCTGCTGTATAGCGTGGAGAGCACCTCGGCGTCCAGCGCACGTGGCTTT

GTGCGCGGTGAGTTTTATACCCAAGACGGCGTACTGGTTGCCTCGACCGT

TCAGGAAGGGGTGATGCGTAATCACAATtaa

In some embodiments, the butyrate gene cassette (e.g., bcd2-etfB3-etfA3-thiA1-hbd-crt2-pbt buk butyrate cassette (pLogic031), and/or ter-thiA1-hbd-crt2-pbt buk butyrate cassette (pLogic046) and/or ter-thiA1-hbd-crt2-tesb butyrate cassette (pLOGIC046-delta pbt.buk/tesB+)) is placed under the control of a FNR regulatory region selected from Table 25 or 26 and SEQ ID NOs: 141-157. In certain constructs, the FNR-responsive promoter is further fused to a strong ribosome binding site sequence. For efficient translation of butyrate genes, each synthetic gene in the operon was separated by a 15 base pair ribosome binding site derived from the T7 promoter/translational start site.

Example 2

Construction of Vectors for Overproducing Butyrate Using an Inducible Tet Promoter-Butyrate Circuit To facilitate inducible production of butyrate in *Escherichia coli* Nissle, the eight genes of the butyrate production pathway from *Peptoclostridium difficile* 630 (bcd2, etfB3, etfA3, thiA1, hbd, crt2, bpt, and buk; NCBI), as well as transcriptional and translational elements, were synthesized (Gen9, Cambridge, Mass.) and cloned into vector pBR322 to create pLogic031. For efficient translation of butyrate genes, each synthetic gene in the operon was separated by a 15 base pair ribosome binding site derived from the T7 promoter.

The gene products of bcd2-etfA3-etfB3 form a complex that convert crotonyl-CoA to butyryl-CoA, and may show some dependence on oxygen as a co-oxidant. For reasons described in Example 1, a second plasmid was generated, in which bcd2-etfA3-etfB3 was replaced with (trans-2-enoynl-CoA reductase; ter from *Treponema denticola* capable of butyrate production in *E. coli*. Inverse PCR was used to amplify the entire sequence of pLogic031 outside of the bcd-etfA3-etfB3 region. The ter gene was codon optimized for *E. coli* codon usage using Integrated DNA technologies online codon optimization tool, synthesized (Genewiz, Cambridge, Mass.), and cloned into this inverse PCR fragment using Gibson assembly to create pLogic046.

A third butyrate gene cassette was further generated, in which the pbt and buk genes were replaced with tesB (SEQ ID NO: 10). TesB is a thioesterase found in *E. Coli* that cleaves off the butyrate from butyryl-coA, thus obviating the need for pbt-buk (see FIG. 2). The third butyrate gene cassette, as well as transcriptional and translational elements, is synthesized (Gen9, Cambridge, Mass.) and cloned into vector pBR322 to create pLOGIC046-delta pbt.buk/tesB+(ter-thiA1-hbd-crt2-tesb butyrate cassette, also referred to herein as tesB butyrate cassette).

As synthesized, the all three butyrate gene cassettes were placed under control of a tetracycline-inducible promoter, with the tet repressor (tetR) expressed constitutively, divergent from the tet-inducible synthetic butyrate operon.

Nucleic acid sequences of tetracycline-regulated constructs comprising a tet promoter are shown in Table 44 and Table 45 and Table 46. Table 44 depicts the nucleic acid sequence of an exemplary tetracycline-regulated construct comprising a tet promoter and a butyrogenic gene cassette (pLogic031-tet-butyrate construct; SEQ ID NO: 78). The sequence encoding TetR is underlined, and the overlapping tetR/tetA promoters are boxed. Table 45 depicts the nucleic acid sequence of an exemplary tetracycline-regulated construct comprising a tet promoter and a butyrogenic gene cassette (pLogic046-tet-butyrate construct; SEQ ID NO: 79). The sequence encoding TetR is underlined, and the overlapping tetR/tetA promoters are boxed.

Table 46 depicts the nucleic acid sequence of an exemplary tetracycline-regulated construct (pLOGIC046-delta pbt.buk/tesB+-tet-butyrate construct) comprising a reverse complement of the tetR repressor (underlined), an intergenic region containing divergent promoters controlling tetR and the butyrate operon and their respective RBS (bold), and the butyrate genes separated by RBS.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 172, 173, or 174, or a functional fragment thereof.

TABLE 44

| pLogic031-tet-butyrate construct (SEQ ID NO: 172) |
|---|
| Nucleotide sequences of pLogic031-tet-butyrate construct (SEQ ID NO: 172) |
| gtaaaacgacggccagtgaattcgttaagacccactttcacatttaagttgtttttctaatccgcatatg |
| atcaattcaaggccgaataagaaggctggctctgcaccttggtgatcaaataattcgatagcttgtcgta |
| ataatggcggcatactatcagtagtaggtgtttccctttcttcttttagcgacttgatgctcttgatcttc |
| caatacgcaacctaaagtaaaatgccccacagcgctgagtgcatataatgcattctctagtgaaaaacct |
| tgttggcataaaaaggctaattgattttcgagagtttcatactgtttttctgtaggccgtgtacctaaat |
| gtacttttgctccatcgcgatgacttagtaaagcacatctaaaacttttagcgttattacgtaaaaaatc |
| ttgccagctttccccttctaaagggcaaaagtgagtatggtgcctatctaacatctcaatggctaaggcg |
| tcgagcaaagcccgcttattttttacatgccaatacaatgtaggctgctctacacctagcttctgggcga |
| gtttacgggttgttaaaccttcgattccgacctcattaagcagctctaatgcgctgttaatcactttact |
| tttatctaatctagacatcattaattcctaattttt gttgacactctatcattgatagagttattttacc |
| actccctatcagtgatagagaa aagtgaactctagaaataattttgtttaactttaagaaggagatatac |
| atatggatttaaattctaaaaaatatcagatgcttaaagagctatatgtaagcttcgctgaaaatgaagt |
| taaacctttagcaacagaacttgatgaagaagaaagatttccttatgaaacagtggaaaaaatggcaaaa |
| gcaggaatgatgggtataccatatccaaaagaatatggtggagaaggtggagacactgtaggatatataa |
| tggcagttgaagaattgtctagagtttgtggtactacaggagttatattatcagctcatacatctcttgg |
| ctcatggcctatatatcaatatggtaatgaagaacaaaaacaaaaattcttaagaccactagcaagtgga |

TABLE 44-continued pLogic031-tet-butyrate construct (SEQ ID NO: 172)

```
gaaaaattaggagcatttggtcttactgagcctaatgctggtacagatgcgtctggccaacaaacaactg
ctgttttagacggggatgaatacatacttaatggctcaaaaatatttataacaaacgcaatagctggtga
catatatgtagtaatggcaatgactgataaatctaaggggaacaaaggaatatcagcatttatagttgaa
aaaggaactcctgggtttagctttggagttaaagaaaagaaaatgggtataagaggttcagctacgagtg
aattaatatttgaggattgcagaatacctaaagaaaatttacttggaaaagaaggtcaaggatttaagat
agcaatgtctactcttgatggtggtagaattggtatagctgcacaagctttaggtttagcacaaggtgct
cttgatgaaactgttaaatatgtaaaagaaagagtacaatttggtagaccattatcaaaattccaaaata
cacaattccaattagctgatatggaagttaaggtacaagcggctagacaccttgtatatcaagcagctat
aaataaagacttaggaaaaccttatggagtagaagcagcaatggcaaaattatttgcagctgaaacagct
atggaagttactacaaaagctgtacaacttcatggaggatatggatacactcgtgactatccagtagaaa
gaatgatgagagatgctaagataactgaaatatatgaaggaactagtgaagttcaaagaatggttatttc
aggaaaactattaaaatagtaagaaggagatatacatatggaggaaggatttatgaatatagtcgtttgt
ataaaacaagttccagatacaacagaagttaaactagatcctaatacaggtactttaattagagatggag
taccaagtataataaaccctgatgataaagcaggtttagaagaagctataaaattaaaagaagaaatggg
tgctcatgtaactgttataacaatgggacctcctcaagcagatatggctttaaaagaagctttagcaatg
ggtgcagatagaggtatattattaacagatagagcatttgcgggtgctgatacttgggcaacttcatcag
cattagcaggagcattaaaaaatatagattttgatattataatagctggaagacaggcgatagatggaga
tactgcacaagttggacctcaaatagctgaacatttaaatcttccatcaataacatatgctgaagaaata
aaaactgaaggtgaatatgtattagtaaaaagacaatttgaagattgttgccatgacttaaaagttaaaa
tgccatgccttataacaactcttaaagatatgaacacaccaagatacatgaaagttggaagaatatatga
tgctttcgaaaatgatgtagtagaaacatggactgtaaaagatatagaagttgacccttctaatttaggt
cttaaaggttctccaactagtgtatttaaatcatttacaaaatcagttaaaccagctggtacaatataca
atgaagatgcgaaaacatcagctggaattatcatagataaattaaaagagaagtatatcatataataaga
aggagatatacatatgggtaacgttttagtagtaatagaacaaagagaaaatgtaattcaaactgtttct
ttagaattactaggaaaggctacagaaatagcaaaagattatgatacaaaagtttctgcattacttttag
gtagtaaggtagaaggtttaatagatacattagcacactatggtgcagatgaggtaatagtagtagatga
tgaagctttagcagtgtatacaactgaaccatatacaaaagcagcttatgaagcaataaaagcagctgac
cctatagttgtattatttggtgcaacttcaatcaggtagagatttagcgcctagagtttctgctagaatac
atacaggtcttactgctgactgtacaggtcttgcagtagctgaagatacaaaattattaatgacaag
acctgcctttggtgaaatataatggcaacaatagtttgtaaagatttcagacctcaaatgtctacagtt
agaccaggggttatgaagaaaatgaacctgatgaaactaaagaagctgtaattaaccgtttcaaggtag
aatttaatgatgctgataaattagttcaagttgtacaagtaataaaagaagctaaaaaacaagttaaaat
agaagatgctaagatattagtttctgctggacgtggaatgggtggaaaagaaaacttagacatactttat
gaattagctgaaattataggtggagaagtttctggttctcgtgccactatagatgcaggttggttagata
aagcaagacaagttggtcaaactggtaaaactgtaagaccagacctttatatagcatgtggtatatctgg
agcaatacaacatatagctggtatggaagatgctgagtttatagttgctataaataaaaatccagaagct
ccaatatttaaatatgctgatgttggtatagttggagatgttcataaagtgcttccagaacttatcagtc
agttaagtgttgcaaaagaaaaggtgaagttttagctaactaataagaaggagatatacatatgagaga
agtagtaattgccagtgcagctagaacagcagtaggaagttttggaggagcatttaaatcagtttcagcg
```

TABLE 44-continued pLogic031-tet-butyrate construct (SEQ ID NO: 172)

gtagagttaggggtaacagcagctaaagaagctataaaaagagctaacataactccagatatgatagatg
aatctcttttaggggagtacttacagcaggtcttggacaaaatatagcaagacaaatagcattaggagc
aggaataccagtagaaaaaccagctatgactataaatatagtttgtggttctggattaagatctgtttca
atggcatctcaacttatagcattaggtgatgctgatataatgttagttggtggagctgaaaacatgagta
tgtctccttatttagtaccaagtgcgagatatggtgcaagaatgggtgatgctgcttttgttgattcaat
gataaagatggattatcagacatatttaataactatcacatgggtattactgctgaaaacatagcagag
caatggaatataactagagaagaacaagatgaattagctcttgcaagtcaaaataaagctgaaaaagctc
aagctgaaggaaaatttgatgaagaaatagttcctgttgttataaaaggaagaaaaggtgacactgtagt
agataaagatgaatatattaagcctggcactacaatggagaaacttgctaagttaagacctgcatttaaa
aaagatggaacagttactgctggtaatgcatcaggaataaatgatggtgctgctatgttagtagtaatgg
ctaaagaaaagctgaagaactaggaatagagcctcttgcaactatagtttcttatggaacagctggtgt
tgaccctaaaataatgggatatggaccagttccagcaactaaaaaagctttagaagctgctaatatgact
attgaagatatagatttagttgaagctaatgaggcatttgctgcccaatctgtagctgtaataagagact
taaatatagatatgaataaagttaatgttaatggtggagcaatagctataggacatccaataggatgctc
aggagcaagaatacttactacacttttatatgaaatgaagagaagagatgctaaaactggtcttgctaca
ctttgtataggcggtggaatgggaactactttaatagttaagagatagtaagaaggagatatacatatga
aattagctgtaataggtagtggaactatgggaagtggtattgtacaaacttttgcaagttgtggacatga
tgtatgtttaaagagtagaactcaaggtgctatagataaatgtttagctttattagataaaaatttaact
aagttagttactaagggaaaaatggatgaagctacaaaagcagaaatattaagtcatgttagttcaacta
ctaattatgaagatttaaaagatatggatttaataatagaagcatctgtagaagacatgaatatataaagaa
agatgttttcaagttactagatgaattatgtaaagaagatactatcttggcaacaaatacttcatcatta
tctataacagaaatagcttcttctactaagcgcccagataaagttataggaatgcatttctttaatccag
ttcctatgatgaaattagttgaagttataagtggtcagttaacatcaaaagttacttttgatacagtatt
tgaattatctaagagtatcaataaagtaccagtagatgtatctgaatctcctggatttgtagtaaataga
atacttatacctatgataaatgaagctgttggtatatatgcagatggtgttgcaagtaaagaagaaatag
atgaagctatgaaattaggagcaaaccatccaatgggaccactagcattaggtgatttaatcggattaga
tgttgttttagctataatgaacgttttatatactgaatttggagatactaaatatagacctcatccactt
ttagctaaaatggttagagctaatcaattaggaagaaaaactaagataggattctatgattataatat
aataagaaggagatatacatatgagtacaagtgatgttaaagtttatgagaatgtagctgttgaagtaga
tggaaatatatgtacagtgaaaatgaatagacctaaagcccttaatgcaataaattcaaagactttagaa
gaactttatgaagtatttgtagatattaataatgatgaaactattgatgttgtaatattgacaggggaag
gaaaggcatttgtagctggagcagatattgcatacatgaaagatttagatgctgtagctgctaaagattt
tagtatcttaggagcaaaagcttttggagaaatagaaaatagtaaaaaagtagtgatagctgctgtaaac
ggatttgctttaggtggaggatgtgaacttgcaatggcatgtgatataagaattgcatctgctaaagcta
aatttggtcagccagaagtaactcttggaataactccaggatatggaggaactcaaaggcttacaagatt
ggttggaatggcaaaagcaaagaattaatctttacaggtcaagttataaaagctgatgaagctgaaaaa
atagggctagtaaatagagtcgttgagccagacattttaatagaagaagttgagaaattagctaagataa
tagctaaaaatgctcagcttgcagttagatactctaaagaagcaatacaacttggtgctcaaactgatat
aaatactggaatagatatagaatctaatttatttggtctttgttttcaactaaagaccaaaaagaagga TABLE 44-continued pLogic031-tet-butyrate construct (SEQ ID NO: 172)

atgtcagctttcgttgaaaagagagaagctaactttataaaagggtaataagaaggagatatacatatga gaagttttgaagaagtaattaagtttgcaaaagaaagaggacctaaaactatatcagtagcatgttgcca agataaagaagttttaatggcagttgaaatggctagaaaagaaaaaatagcaaatgccattttagtagga gatatagaaaagactaaagaaattgcaaaaagcatagacatggatatcgaaaattatgaactgatagata taaaagatttagcagaagcatctctaaaatctgttgaattagtttcacaaggaaaagccgacatggtaat gaaaggcttagtagacacatcaataatactaaaagcagttttaaataaagaagtaggtcttagaactgga aatgtattaagtcacgtagcagtatttgatgtagagggatatgatagattattttttcgtaactgacgcag ctatgaacttagctcctgatacaaatactaaaaagcaaatcatagaaaatgcttgcacagtagcacattc attagatataagtgaaccaaaagttgctgcaatatgcgcaaaagaaaaagtaaatccaaaaatgaaagat acagttgaagctaaagaactagaagaaatgtatgaaagaggagaaatcaaaggttgtatggttggtgggc cttttgcaattgataatgcagtatctttagaagcagctaaacataaaggtataaatcatcctgtagcagg acgagctgatatattattagccccagatattgaaggtggtaacatattatataaagctttggtattcttc tcaaaatcaaaaaatgcaggagttatagttggggctaaagcaccaataatattaacttctagagcagaca gtgaagaaactaaactaaactcaatagctttaggtgtttttaatggcagcaaaggcataataagaaggaga tatacatatgagcaaaatatttaaaatcttaacaataaatcctggttcgacatcaactaaaatagctgta tttgataatgaggatttagtatttgaaaaaactttaagacattcttcagaagaaataggaaaatatgaga aggtgtctgaccaatttgaatttcgtaaacaagtaatagaagaagctctaaaagaaggtggagtaaaaac atctgaattagatgctgtagtaggtagaggaggacttcttaaacctataaaaggtggtacttattcagta agtgctgctatgattgaagatttaaaagtgggagttttaggagaacacgcttcaaacctaggtggaataa tagcaaaacaaataggtgaagaagtaaatgttccttcatacatagtagaccctgttgttgtagatgaatt agaagatgttgctagaaatttctggtatgcctgaaataagtagagcaagtgtagtacatgctttaaatcaa aaggcaatagcaagaagatatgctagagaaataaacaagaaatatgaagatataaatcttatagttgcac acatgggtggaggagtttctgttggagctcataaaaatggtaaaatagtagatgttgcaaacgcattaga tggagaaggacctttctctccagaaagaagtggtggactaccagtaggtgcattagtaaaaatgtgcttt agtggaaaatatactcaagatgaaattaaaaagaaataaaaggtaatggcggactagttgcatacttaa acactaatgatgctagagaagttgaagaaagaattgaagctggtgatgaaaaagctaaattagtatatga agctatggcatatcaaatctctaaagaaataggagctagtgctgcagttcttaagggagatgtaaaagca atattattaactggtggaatcgcatattcaaaaatgtttacagaaatgattgcagatagagttaaattta tagcagatgtaaaagtttatccaggtgaagatgaaatgattgcattagctcaaggtggacttagagtttt aactggtgaagaagaggctcaagtttatgataactaataa

TABLE 45 pLogic046-tet-butyrate construct (SEQ ID NO: 173)

Nucleotide sequences of pLogic046-tet-butyrate construct (SEQ ID NO: 173)
gtaaaacgacggccagtgaattcgttaagacccactttcacatttaagttgttttttctaatccgcatatg atcaattcaaggccgaataagaaggctggctctgcaccttggtgatcaaataattcgatagcttgtcgta ataatggcggcatactatcagtagtaggtgtttccctttcttctttagcgacttgatgctcttgatcttc caatacgcaaccctaaagtaaaatgccccacagcgctgagtgcatataatgcattctctagtgaaaaacct tgttggcataaaaaggctaattgattttcgagagtttcatactgttttttctgtaggccgtgtacctaaat TABLE 45-continued pLogic046-tet-butyrate construct (SEQ ID NO: 173)

gtacttttgctccatcgcgatgacttagtaaagcacatctaaaacttttagcgttattacgtaaaaatc ttgccagctttccccttctaaagggcaaaagtgagtatggtgcctatctaacatctcaatggctaaggcg tcgagcaaagcccgcttatttttttacatgccaatacaatgtaggctgctctacacctagcttctgggcga gtttacgggttgttaaaccttcgattccgacctcattaagcagctctaatgcgctgttaatcactttact tttatctaatctagacatcattaattcctaatttttgttgacactctatcattgatagagttattttacc actccctatcagtgatagagaaaagtgaactctagaaataattttgtttaactttaagaaggagatatac atatgatcgtaaaacctatggtacgcaacaatatctgcctgaacgcccatcctcagggctgcaagaaggg agtggaagatcagattgaatataccaagaaacgcattaccgcagaagtcaaagctggcgcaaaagctcca aaaaacgttctggtgcttggctgctcaaatggttacggcctggcgagccgcattactgctgcgttcggat acggggctgcgaccatcggcgtgtcctttgaaaaagcgggttcagaaaccaaatatggtacaccgggatg gtacaataatttggcatttgatgaagcggcaaaacgcgagggtctttatagcgtgacgatcgacggcgat gcgttttcagacgagatcaaggcccaggtaattgaggaagccaaaaaaaaaggtatcaaatttgatctga tcgtatacagcttggccagcccagtacgtactgatcctgatacaggtatcatgcacaaaagcgttttgaa accctttggaaaaacgttcacaggcaaaacagtagatccgtttactggcgagctgaaggaaatctccgcg gaaccagcaaatgacgaggaagcagccgccactgttaaagttatggggggtgaagattgggaacgttgga ttaagcagctgtcgaaggaaggcctcttagaagaaggctgtattaccttggcctatagttatattggccc tgaagctacccaagctttgtaccgtaaaggcacaatcggcaaggccaaagaacacctggaggccacagca caccgtctcaacaaagagaacccgtcaatccgtgccttcgtgagcgtgaataaaggcctggtaacccgcg caagcgccgtaatcccggtaatccctctgtatctcgccagcttgttcaaagtaatgaaagagaagggcaa tcatgaaggttgtattgaacagatcacgcgtctgtacgccgagcgcctgtaccgtaaagatggtacaatt ccagttgatgaggaaaatcgcattcgcattgatgattgggagttagaagaagacgtccagaaagcggtat ccgcgttgatggagaaagtcacgggtgaaaacgcagaatctctcactgacttagcgggggtaccgccatga tttcttagctagtaacggctttgatgtagaaggtattaattatgaagcggaagttgaacgcttcgaccgt atctgataagaaggagatatacatatgagagaagtagtaattgccagtgcagctagaacagcagtaggaa gttttggaggagcatttaaatcagtttcagcggtagagttaggggtaacagcagctaaagaagctataaa aagagctaacataactccagatatgatagatgaatctcttttaggggagtacttacagcaggtcttgga caaaatatagcaagacaaatagcattaggagcaggaataccagtagaaaaaccagctatgactataaata tagtttgtggttctggattaagatctgtttcaatggcatctcaacttatagcattaggtgatgctgatat aatgttagttggtggagctgaaaacatgagtatgtctccttatttagtaccaagtgcgagatatggtgca agaatgggtgatgctgcttttgttgattcaatgataaaagatggattatcagacatatttaataactatc acatgggtattactgctgaaaacatagcagagcaatggaatataactagagaagaacaagatgaattagc tcttgcaagtcaaaataaagctgaaaaagctcaagctgaaggaaaatttgatgaagaaatagttcctgtt gttataaaaggaagaaaaggtgacactgtagtagataaagatgaatatattaagcctggcactacaatgg agaaacttgctaagttaagacctgcatttaaaaaagatggaacagttactgctggtaatgcatcaggaat aaatgatggtgctgctatgttagtagtaatggctaaagaaaagctgaagaactaggaatagagcctctt gcaactatagtttcttatggaacagctggtgttgaccctaaaataatgggatatggaccagttccagcaa ctaaaaaagcttttagaagctgctaatatgactattgaagatatagatttagttgaagctaatgaggcatt tgctgcccaatctgtagctgtaataagagacttaaatatagatatgaataaagtaatgttaatggtgga TABLE 45-continued pLogic046-tet-butyrate construct (SEQ ID NO: 173)

gcaatagctataggacatccaataggatgctcaggagcaagaatacttactcacttttatatgaaatga agagaagagatgctaaaactggtcttgctacactttgtataggcggtggaatgggaactactttaatagt taagagatagtaagaaggagatatacatatgaaattagctgtaataggtagtggaactatgggaagtggt attgtacaaacttttgcaagttgtggacatgatgtatgtttaaagagtagaactcaaggtgctatagata aatgtttagctttattagataaaaatttaactaagttagttactaagggaaaaatggatgaagctacaaa agcagaaatattaagtcatgttagttcaactactaattatgaagatttaaaagatatggatttaataata gaagcatctgtagaagacatgaatataaagaaagatgttttcaagttactagatgaattatgtaaagaag atactatcttggcaacaaatacttcatcattatctataacagaaatagcttcttctactaagcgcccaga taaagttataggaatgcatttctttaatccagttcctatgatgaaattagttgaagttataagtggtcag ttaacatcaaaagttacttttgatacagtatttgaattatctaagagtatcaataaagtaccagtagatg tatctgaatctcctggatttgtagtaaatagaatacttatacctatgataaatgaagctgttggtatata tgcagatggtgttgcaagtaaagaagaaatagatgaagctatgaattaggagcaaaccatccaatggga ccactagcattaggtgatttaatcggattagatgttgttttagctataatgaacgttttatatactgaat ttggagatactaaatatagacctcatccacttttagctaaaatggttagagctaatcaattaggaagaaa aactaagataggattctatgattataataaataataagaaggagatatacatatgagtacaagtgatgtt aaagtttatgagaatgtagctgttgaagtagatggaaatatatgtacagtgaaaatgaatagacctaaag cccttaatgcaataaattcaaagactttagaagaactttatgaagtatttgtagatattaataatgatga aactattgatgttgtaatattgacaggggaaggaaaggcatttgtagctggagcagatattgcatacatg aaagatttagatgctgtagctgctaaagattttagtatcttaggagcaaaagcttttggagaaatagaaa atagtaaaaagtagtgatagctgctgtaaacggatttgctttaggtggaggatgtgaacttgcaatggc atgtgatataagaattgcatctgctaaagctaaatttggtcagccagaagtaactcttggaataactcca ggatatggaggaactcaaaggcttacaagattggttggaatggcaaaagcaaaagaattaatctttacag gtcaagttataaaagctgatgaagctgaaaaaatagggctagtaaatagagtcgttgagccagacatttt aatagaagaagttgagaaattagctaagataatagctaaaaatgctcagcttgcagttagatactctaaa gaagcaatacaacttggtgctcaaactgatataaatactggaatagatatagaatctaatttatttggtc tttgtttttcaactaaagaccaaaaagaaggaatgtcagctttcgttgaaaagagagaagctaactttat aaaagggtaataagaaggagatatacatatgagaagttttgaagaagtaattaagtttgcaaaagaaaga ggacctaaaactatatcagtagcatgttgccaagataaagaagtttttaatggcagttgaaatggctagaa aagaaaaaatagcaaatgccatttagtaggagatatagaaaagactaaagaaattgcaaaagcataga catggatatcgaaaattatgaactgatagatataaaagatttagcagaagcatctctaaaatctgttgaa ttagtttcacaaggaaaagccgacatggtaatgaaaggcttagtagacacatcaataatactaaaagcag ttttaaataaagaagtaggtcttagaactggaaatgtattaagtcacgtagcagtatttgatgtagaggg atatgatagattattttcgtaactgacgcagctatgaacttagctcctgatacaaatactaaaaagcaa atcatagaaaatgcttgcacagtagcacattcattagatataagtgaaccaaaagttgctgcaatatgcg caaaagaaaaagtaaatccaaaaatgaaagatacagttgaagctaaagaactagaagaaatgtatgaaag aggagaaatcaaggttgtatggttggtgggccttttgcaattgataatgcagtatcttagaagcagct aaacataaaggtataaatcatcctgtagcaggacgagctgatatattattagccccagatattgaaggtg gtaacatattatataaagctttggtattcttctcaaaatcaaaaaatgcaggagttatagttggggctaa agcaccaataatattaacttctagagcagacagtgaagaaactaaactaaactcaatagctttaggtgtt TABLE 45-continued pLogic046-tet-butyrate construct (SEQ ID NO: 173)

ttaatggcagcaaaggcataataagaaggagatatacatatgagcaaaatatttaaaatcttaacaataa atcctggttcgacatcaactaaaatagctgtatttgataatgaggatttagtatttgaaaaaactttaag acattcttcagaagaaataggaaaatatgagaaggtgtctgaccaatttgaatttcgtaaacaagtaata gaagaagctctaaaagaaggtggagtaaaaacatctgaattagatgctgtagtaggtagaggaggacttc ttaaaccctataaaaggtggtacttattcgtaagtgctgctatgattgaagatttaaaagtgggagtttt aggagaacacgcttcaaacctaggtggaataatagcaaaacaaataggtgaagaagtaaatgttccttca tacatagtagaccctgttgttgtagatgaattagaagatgttgctagaatttctggtatgcctgaaataa gtagagcaagtgtagtacatgcttttaaatcaaaaggcaatagcaagaagatatgctagagaaataaacaa gaaatatgaagatataaatcttatagttgcacacatgggtggaggagtttctgttggagctcataaaaat ggtaaaatagtagatgttgcaaacgcattagatggagaaggaccttctctccagaaagaagtggtggac taccagtaggtgcattagtaaaaatgtgctttagtggaaaatatactcaagatgaaattaaaaagaaaat aaaaggtaatggcggactagttgcatacttaaacactaatgatgctagagaagttgaagaaagaattgaa gctggtgatgaaaaagctaaattagtatatgaagctatggcatatcaaatctctaaagaaataggagcta gtgctgcagttcttaagggagatgtaaaagcaatattattaactggtggaatcgcatattcaaaaatgtt tacagaaatgattgcagatagagttaaatttatagcagatgtaaaagtttatccaggtgaagatgaaatg attgcattagctcaaggtggacttagagttttaactggtgaagaagaggctcaagtttatgataactaat aa

TABLE 46 pLOGIC046-delta pbt.buk/tesB+-tet-butyrate
construct (SEQ ID NO: 174)
SEQ ID NO: 174 gtaaaacgacggccagtgaattcgttaagacccactttcacatttaagtt
gttttttctaatccgcatatgatcaattcaaggccgaataagaaggctggc
tctgcaccttggtgatcaaataattcgatagcttgtcgtaataatgcgg
catactatcagtagtaggtgtttccctttcttctttagcgacttgatgct
cttgatcttccaatacgcaacctaaagtaaaatgccccacagcgctgagt
gcatataatgcattctctagtgaaaaaccttgttggcataaaaaggctaa
ttgattttcgagagtttcatactgttttctgtaggccgtgtacctaaat
gtacttttgctccatcgcgatgacttagtaaagcacatctaaaacttta
gcgttattacgtaaaaaatcttgccagctttcccttctaaagggcaaaa
gtgagtatggtgcctatctaacatctcaatggctaaggcgtcgagcaaag
cccgcttatttttacatgccaatacaatgtaggctgctctacacctagc
ttctgggcgagtttacgggttgttaaaccttcgattccgacctcattaag
cagctctaatgcgctgttaatcacttttactttttatctaatctagacatca
ttaattcctaattttgttgacactctatcattgatagagttattttacc
actccctatcagtgatagagaaaagtgaactctagaaataattttgttta
actttaagaaggagatatacatgatcgtaaaacctatggtacgcaaca
atatctgcctgaacgccatcctcagggctgcaagaagggagtggaagat
cagattgaatataccaagaaacgcattaccgcagaagtcaaagctggcgc TABLE 46-continued pLOGIC046-delta pbt.buk/tesB+-tet-butyrate
construct (SEQ ID NO: 174)
SEQ ID NO: 174 aaaagctccaaaaaacgttctggtgcttggctgctcaaatggttacggcc
tggcgagccgcattactgctgcgttcggatacggggctgcgaccatcggc
gtgtcctttgaaaaagcgggttcagaaaccaaatatggtacaccgggatg
gtacaataatttggcattgatgaagcggcaaaacgcgagggtctttata
gcgtgacgatcgacggcgatgcgtttcagacgagatcaaggcccaggta
attgaggaagccaaaaaaaggtatcaaatttgatctgatcgtatacag
cttggccagcccagtacgtactgatcctgatacaggtatcatgcacaaaa
gcgttttgaaacccttggaaaaacgttcacaggcaaaacagtagatccg
tttactggcgagctgaaggaaatctccgcggaaccagcaaatgacgagga
agcagccgccactgttaaagttatgggggtgaagattgggaacgttgga
ttaagcagctgtcgaaggaaggcctcttagaagaaggctgtattaccttg
gcctatagttatattggccctgaagctacccaagctttgtaccgtaaagg
cacaatcggcaaggccaaagaacacctggaggccacagcacaccgtctca
acaaagagaacccgtcaatccgtgccttcgtgagcgtgaataaaggcctg
gtaacccgcgcaagcgccgtaatcccggtaatccctctgtatctcgccag
cttgttcaaagtaatgaaagagaagggcaatcatgaaggttgtattgaac
agatcacgcgtctgtacgccgagcgcctgtaccgtaaagatggtacaatt

TABLE 46-continued pLOGIC046-delta pbt.buk/tesB+-tet-butyrate
construct (SEQ ID NO: 174)
SEQ ID NO: 174 ccagttgatgaggaaaatcgcattcgcattgatgattgggagttagaaga
agacgtccagaaagcggtatccgcgttgatggagaaagtcacgggtgaaa
acgcagaatctctcactgacttagcggggtaccgccatgatttcttagct
agtaacggctttgatgtagaaggtattaattatgaagcggaagttgaacg
cttcgaccgtatctgataagaaggagatatacatatgagagaagtagtaa
ttgccagtgcagctagaacagcagtaggaagttttggaggagcatttaaa
tcagtttcagcggtagagttaggggtaacagcagctaaagaagctataaa
aagagctaacataactccagatatgatagatgaatctcttttaggggag
tacttacagcaggtcttggacaaaatatagcaagacaaatagcattagga
gcaggaataccagtagaaaaaccagctatgactataaatatagtttgtgg
ttctggattaagatctgtttcaatggcatctcaacttatagcattaggtg
atgctgatataatgttagttggtggagctgaaaacatgagtatgtctcct
tatttagtaccaagtgcgagatatggtgcaagaatgggtgatgctgcttt
tgttgattcaatgataaaagatggattatcagacatatttaataactatc
acatgggtattactgctgaaaacatagcagagcaatggaatataactaga
gaagaacaagatgaattagctcttgcaagtcaaaatataaagctgaaaaagc
tcaagctgaaggaaaatttgatgaagaaatagttcctgttgttataaaag
gaagaaaaggtgacactgtagtagataaagatgaatatattaagcctggc
actacaatggagaaacttgctaagttaagacctgcatttaaaaaagatgg
aacagttactgctggtaatgcatcaggaataaatgatggtgctgctatgt
tagtagtaatggctaaagaaaaagctgaagaactaggaatagagcctctt
gcaactatagtttcttatggaacagctggtgttgaccctaaaaataatggg
atatggaccagttccagcaactaaaaaagcttagagagctgctaatatga
ctattgaagatatagattagttgaagctaatgaggcatttgctgcccaa
tctgtagctgtaataagagacttaaatatagatatgaataaagttaatgt
taatggtggagcaatagctataggacatccaataggatgctcaggagcaa
gaatacttactacacttttatatgaaatgaagagaagagatgctaaaact
ggtcttgctacactttgtataggcggtggaatgggaactactttaatagt
taagagatagtaagaaggagatatacatatgaaattagctgtaataggta
gtggaactatgggaagtggtattgtacaaacttttgcaagttgtggacat
gatgtatgtttaaagagtagaacctcaaggtgctatagataaatgtttagc
tttattagataaaaatttaactaagttagttactaagggaaaaatggatg
aagctacaaaagcagaaatattaagtcatgttagttcaactactaattat
gaagatttaaaagatatggatttaataatagaagcatctgtagaagacat
gaatataaagaaagatgttttcaagttactagatgaattatgtaaagaag
atactatcttggcaacaaatacttcatcattatctataacagaaatagct
tcttctactaagcgcccagataaagttataggaatgcatttctttaatcc
agttcctatgatgaaattagttgaagttataagtggtcagttaacatcaa

TABLE 46-continued pLOGIC046-delta pbt.buk/tesB+-tet-butyrate
construct (SEQ ID NO: 174)
SEQ ID NO: 174 aagttacttttgatacagtatttgaattatctaagagtatcaataaagta
ccagtagatgtatctgaatctcctggatttgtagtaaatagaatacttat
acctatgataaatgaagctgttggtatatatgcagatggtgttgcaagta
aagaagaaatagatgaagctatgaaattaggagcaaaccatccaatggga
ccactagcattaggtgatttaatcggattagatgttgttttagctataat
gaacgttttatatactgaatttggagatactaaatatagacctcatccac
ttttagctaaaatggttagagctaatcaattaggaagaaaaactaagata
ggattctatgattataataaataataagaaggagatatacatatgagtac
aagtgatgttaaagtttatgagaatgtagctgttgaagtagatggaaata
tatgtacagtgaaaatgaatagacctaaagcccttaatgcaataaattca
aagactttagaagaactttatgaagtatttgtagatattaataatgatga
aactattgatgttgtaatattgacaggggaaggaaaggcatttgtagctg
gagcagatattgcatacatgaaagatttagatgctgtagctgctaaagat
tttagtatcttaggagcaaaagcttttggagaaatagaaaatagtaaaaa
agtagtgatagctgctgtaaacgatttgctttaggtggaggatgtgaac
ttgcaatggcatgtgataagaattgcatctgctaaagctaaatttggt
cagccagaagtaactcttggaataactccaggatatggaggaactcaaag
gcttacaagattggttggaatggcaaaagcaaaagaattaatctttacag
gtcaagttataaaagctgatgaagctgaaaaaatagggctagtaaataga
gtcgttgagccagacatttttaatagaagaagttgagaaattagctaagat
aatagctaaaaatgctcagcttgcagttagatactctaaagaagcaatac
aacttggtgctcaaactgatataaaatactggaatagatatagaatctaat
ttatttggtctttgttttttcaactaaagaccaaaaagaaggaatgtcagc
tttcgttgaaaagagagaagctaactttataaaagggtaataagaaggag
atatacatatgAGTCAGGCGCTAAAAAATTTACTGACATTGTTAAATCTG
GAAAAAATTGAGGAAGGACTCTTTCGCGGCCAGAGTGAAGATTTAGGTTT
ACGCCAGGTGTTTGGCGGCCAGGTCGTGGGTCAGGCCTTGTATGCTGCAA
AAGAGACCGTCCCTGAAGAGCGGCTGGTACATTCGTTTCACAGCTACTTT
CTTCGCCCTGGCGATAGTAAGAAGCCGATTATTTATGATGTCGAAACGCT
GCGTGACGGTAACAGCTTCAGCGCCCGCCGGGTTGCTGCTATTCAAAACG
GCAAACCGATTTTTTATATGACTGCCTCTTTCCAGGCACCAGAAGCGGGT
TTCGAACATCAAAAAACAATGCCGTCCGCGCCAGCGCCTGATGGCCTCCC
TTCGGAAACGCAAATCGCCCAATCGCTGGCGCACCTGCTGCCGCCAGTGC
TGAAAGATAAATTCATCTGCGATCGTCCGCTGGAAGTCCGTCCGGTGGAG
TTTCATAACCCACTGAAAGGTCACGTCGCAGAACCACATCGTCAGGTGTG
GATCCGCGCAAATGGTAGCGTGCCGGATGACCTGCGCGTTCATCAGTATC
TGCTCGGTTACGCTTCTGATCTTAACTTCCTGCCGGTAGCTCTACAGCCG
CACGGCATCGGTTTTCTCGAACCGGGGATTCAGATTGCCACCATTGACCA TABLE 46-continued pLOGIC046-delta pbt.buk/tesB+-tet-butyrate
construct (SEQ ID NO: 174)
SEQ ID NO: 174

TTCCATGTGGTTCCATCGCCCGTTTAATTTGAATGAATGGCTGCTGTATA

GCGTGGAGAGCACCTCGGCGTCCAGCGCACGTGGCTTTGTGCGCGGTGAG

TTTTATACCCAAGACGGCGTACTGGTTGCCTCGACCGTTCAGGAAGGGGT

GATGCGTAATCACAATtaa

Butyrate, IL-10, IL-22, GLP-2

In certain constructs, in addition to the butyrate production pathways described above, the *Escherichia coli* Nissle are further engineered to produce one or more molecules selected from IL-10, IL-2, IL-22, IL-27, SOD, kyurenine, kyurenic acid, and GLP-2 using the methods described above. In some embodiments, the bacteria comprise a gene cassette for producing butyrate as described above, and a gene encoding IL-10 (see, e.g., SEQ ID NO: 134, SEQ ID NO: 193, SEQ ID NO: 197, SEQ ID NO: 198, SEQ ID NO: 194). In some embodiments, the bacteria comprise a gene cassette for producing butyrate as described above, and a gene encoding IL-2 (see, e.g., SEQ ID NO: 135). In some embodiments, the bacteria comprise a gene cassette for producing butyrate as described above, and a gene encoding IL-22 (see, e.g., SEQ ID NO: 136, SEQ ID NO: 195, SEQ ID NO: 196). In some embodiments, the bacteria comprise a gene cassette for producing butyrate as described above, and a gene encoding IL-27 (see, e.g., SEQ ID NO: 137). In some embodiments, the bacteria comprise a gene cassette for producing butyrate as described above, and a gene encoding SOD (see, e.g., SEQ ID NO: 138). In some embodiments, the bacteria comprise a gene cassette for producing butyrate as described above, and a gene encoding GLP-2 (see, e.g., SEQ ID NO: 139, SEQ ID NO: 140, SEQ ID NO: 136189, SEQ ID NO: 190, SEQ ID NO: 192). In some embodiments, the bacteria comprise a gene cassette for producing butyrate as described above, and a gene or gene cassette for producing kyurenine or kyurenic acid. In some embodiments, the bacteria comprise a gene cassette for producing butyrate as described above, and a gene encoding IL-10, IL-22, and GLP-2. In one embodiment, each of the genes or gene cassettes is placed under the control of a FNR regulatory region selected from SEQ ID NO: 141 through SEQ ID NO: 157 (Table 25 and Table 26). In an alternate embodiment, each of the genes or gene cassettes is placed under the control of an RNS-responsive regulatory region, e.g., norB, and the bacteria further comprises a gene encoding a corresponding RNS-responsive transcription factor, e.g., nsrR (see, e.g., Table 27 and elsewhere herein). In yet another embodiment, each of the genes or gene cassettes is placed under the control of an ROS-responsive regulatory region, e.g., oxyS, and the bacteria further comprises a gene encoding a corresponding ROS-responsive transcription factor, e.g., oxyR (see, e.g., Table 28 and Table 29 and elsewhere herein). In certain constructs, one or more of the genes is placed under the control of a tetracycline-inducible or constitutive promoter.

Butyrate, Propionate, IL-10, IL-22, IL-2, IL-27

In certain constructs, in addition to the butyrate production pathways described above, the *Escherichia coli* Nissle are further engineered to produce propionate, and one or more molecules selected from IL-10, IL-2, IL-22, IL-27, SOD, kyurenine, kyurenic acid, and GLP-2 using the methods described above. In certain constructs, in addition to the butyrate production pathways described above, the *Escherichia coli* Nissle are further engineered to produce propionate, and one or more molecules selected from IL-10, IL-2, and IL-22. In certain constructs, in addition to the butyrate production pathways described above, the *Escherichia coli* Nissle are further engineered to produce propionate, and one or more molecules selected from IL-10, IL-2, and IL-27. In some embodiments, the genetically engineered bacteria further comprise acrylate pathway genes for propionate biosynthesis, pct, lcdA, lcdB, lcdC, etfA, acrB, and acrC. In an alternate embodiment, the genetically engineered bacteria comprise pyruvate pathway genes for propionate biosynthesis, thrA$^{fbr}$, thrB, thrC, ilvA$^{fbr}$, aceE, aceF, and lpd. In another alternate embodiment, the genetically engineered bacteria comprise thrA$^{fbr}$, thrB, thrC, ilvA aceE, aceF, lpd, and tesB.

The bacteria comprise a gene cassette for producing butyrate as described above, a gene cassette for producing propionate as described above, a gene encoding IL-10 (see, e.g., 49), a gene encoding IL-27 (see, e.g., SEQ ID NO: 137), a gene encoding IL-22 (see, e.g., SEQ ID NO: 136, SEQ ID NO: 195, SEQ ID NO: 196), and a gene encoding IL-2 (see, e.g., SEQ ID NO: 135). In one embodiment, each of the genes or gene cassettes is placed under the control of a FNR regulatory region selected from SEQ ID NOs: 141-157 (Table 25 and 26). In an alternate embodiment, each of the genes or gene cassettes is placed under the control of an RNS-responsive regulatory region, e.g., norB, and the bacteria further comprises a gene encoding a corresponding RNS-responsive transcription factor, e.g., nsrR (see, e.g., Table 27). In yet another embodiment, each of the genes or gene cassettes is placed under the control of an ROS-responsive regulatory region, e.g., oxyS, and the bacteria further comprises a gene encoding a corresponding ROS-responsive transcription factor, e.g., oxyR (see, e.g., Table 28 and elsewhere herein). In certain constructs, one or more of the genes is placed under the control of a tetracycline-inducible or constitutive promoter.

Butyrate, Propionate, IL-10, L-22, SOD, GLP-2, Kynurenine

In certain constructs, in addition to the butyrate production pathways described above, the *Escherichia coli* Nissle are further engineered to produce one or more molecules selected from IL-10, IL-22, SOD, GLP-2, and kynurenine using the methods described above. In certain constructs, in addition to the butyrate production pathways described above, the *Escherichia coli* Nissle are further engineered to produce propionate, and one or more molecules selected from IL-10, IL-22, SOD, GLP-2, and kynurenine using the methods described above. In certain constructs, in addition to the butyrate production pathways described above, the *Escherichia coli* Nissle are further engineered to produce IL-10, IL-27, IL-22, SOD, GLP-2, and kynurenine using the methods described above. In certain constructs, in addition to the butyrate production pathways described above, the *Escherichia coli* Nissle are further engineered to produce propionate, IL-10, IL-27, IL-22, SOD, GLP-2, and kynurenine using the methods described above. In some embodiments, the genetically engineered bacteria further comprise acrylate pathway genes for propionate biosynthesis, pct, lcdA, lcdB, lcdC, etfA, acrB, and acrC. In an alternate embodiment, the genetically engineered bacteria comprise pyruvate pathway genes for propionate biosynthesis, thrA$^{fbr}$, thrB, thrC, ilvA$^{fbr}$, aceE, aceF, and lpd. In another alternate embodiment, the genetically engineered bacteria comprise thrA$^{fbr}$, thrB, thrC, ilvA$^{fbr}$, aceE, aceF, lpd, and tesB.

The bacteria comprise a gene cassette for producing butyrate as described above, a gene cassette for producing propionate as described above, a gene encoding IL-10 (see, e.g., SEQ ID NO: 134), a gene encoding IL-22 (see, e.g., SEQ ID NO: 136, SEQ ID NO: 195, SEQ ID NO: 196), a gene encoding SOD (see, e.g., SEQ ID NO: 138), a gene encoding GLP-2 or a GLP-2 analog or GLP-2 polypeptide (see, e.g., SEQ ID NO: 139, SEQ ID NO:140, SEQ ID NO:189, SEQ ID NO:190, SEQ ID NO: 192), and a gene or gene cassette for producing kynurenine. In one embodiment, each of the genes or gene cassettes is placed under the control of a FNR regulatory region selected from SEQ ID NO: 141 though SEQ ID NO: 157 (Table 25 and Table 26). In an alternate embodiment, each of the genes or gene cassettes is placed under the control of an RNS-responsive regulatory region, e.g., norB, and the bacteria further comprises a gene encoding a corresponding RNS-responsive transcription factor, e.g., nsrR (see, e.g., Table 27 and elsewhere herein). In yet another embodiment, each of the genes or gene cassettes is placed under the control of an ROS-responsive regulatory region, e.g., oxyS, and the bacteria further comprises a gene encoding a corresponding ROS-responsive transcription factor, e.g., oxyR (see, e.g., Table 28 and Table 29 and elsewhere herein). In certain constructs, one or more of the genes is placed under the control of a tetracycline-inducible or constitutive promoter.

Butyrate, Propionate, IL-10, IL-27, IL-22, IL-2, SOD, GLP-2, Kynurenine

In certain constructs, in addition to the butyrate production pathways described above, the *Escherichia coli Nissle* are further engineered to produce one or more molecules selected from IL-10, IL-27, IL-22, IL-2, SOD, GLP-2, and kynurenine using the methods described above. In certain constructs, in addition to the butyrate production pathways described above, the *Escherichia coli Nissle* are further engineered to produce propionate and one or more molecules selected from IL-10, IL-27, IL-22, IL-2, SOD, GLP-2, and kynurenine using the methods described above. In certain constructs, in addition to the butyrate production pathways described above, the *Escherichia coli Nissle* are further engineered to produce IL-10, IL-27, IL-22, SOD, GLP-2, and kynurenine using the methods described above. In some embodiments, the genetically engineered bacteria further comprise acrylate pathway genes for propionate biosynthesis, pct, lcdA, lcdB, lcdC, etfA, acrB, and acrC. In an alternate embodiment, the genetically engineered bacteria comprise pyruvate pathway genes for propionate biosynthesis, thrA thrB, thrC, ilvA$^{fbr}$, aceE, aceF, and lpd. In another alternate embodiment, the genetically engineered bacteria comprise thrA$^{fbr}$, thrB, thrC, ilvA$^{fbr}$, aceE, aceF, lpd, and tesB.

The bacteria comprise a gene cassette for producing butyrate as described above, a gene cassette for producing propionate as described above, a gene encoding IL-10 (see, e.g., SEQ ID NO: 134, SEQ ID NO: 193, SEQ ID NO: 197, SEQ ID NO: 198, SEQ ID NO: 194), a gene encoding IL-27 (see, e.g., SEQ ID NO: 137), a gene encoding IL-22 (see, e.g., SEQ ID NO: 51), a gene encoding IL-2 (see, e.g., SEQ ID NO: 50), a gene encoding SOD (see, e.g., SEQ ID NO: 53), a gene encoding GLP-2 (see, e.g., SEQ ID NO: 54), and a gene or gene cassette for producing kynurenine. In one embodiment, each of the genes or gene cassettes is placed under the control of a FNR regulatory region selected from SEQ ID NO: 141 through SEQ ID NO: 157 (Table 25 and Table 26). In an alternate embodiment, each of the genes or gene cassettes is placed under the control of an RNS-responsive regulatory region, e.g., norB, and the bacteria further comprises a gene encoding a corresponding RNS-responsive transcription factor, e.g., nsrR (see, e.g., Table 28 and Table 29 and elsewhere herein). In yet another embodiment, each of the genes or gene cassettes is placed under the control of an ROS-responsive regulatory region, e.g., oxyS, and the bacteria further comprises a gene encoding a corresponding ROS-responsive transcription factor, e.g., oxyR (see, e.g., Table 28 and Table 29 and elsewhere herein). In certain constructs, one or more of the genes is placed under the control of a tetracycline-inducible or constitutive promoter.

In some embodiments, bacterial genes may be disrupted or deleted to produce an auxotrophic strain. These include, but are not limited to, genes required for oligonucleotide synthesis, amino acid synthesis, and cell wall synthesis, as shown in Table 33.

Example 3

Transforming *E. coli*

Each plasmid is transformed into *E. coli* Nissle or *E. coli* DHSa. All tubes, solutions, and cuvettes are pre-chilled to 4° C. An overnight culture of *E. coli* Nissle or *E. coli* DHSa is diluted 1:100 in 5 mL of lysogeny broth (LB) and grown until it reached an OD$_{600}$ of 0.4-0.6. The cell culture medium contains a selection marker, e.g., ampicillin, that is suitable for the plasmid. The *E. coli* cells are then centrifuged at 2,000 rpm for 5 min. at 4° C., the supernatant is removed, and the cells are resuspended in 1 mL of 4° C. water. The *E. coli* are again centrifuged at 2,000 rpm for 5 min. at 4° C., the supernatant is removed, and the cells are resuspended in 0.5 mL of 4° C. water. The *E. coli* are again centrifuged at 2,000 rpm for 5 min. at 4° C., the supernatant is removed, and the cells are finally resuspended in 0.1 mL of 4° C. water. The electroporator is set to 2.5 kV. 0.5 µg of one of the above plasmids is added to the cells, mixed by pipetting, and pipetted into a sterile, chilled cuvette. The dry cuvette is placed into the sample chamber, and the electric pulse is applied. One mL of room-temperature SOC media is immediately added, and the mixture is transferred to a culture tube and incubated at 37° C. for 1 hr. The cells are spread out on an LB plate containing ampicillin and incubated overnight.

Figure 2A:
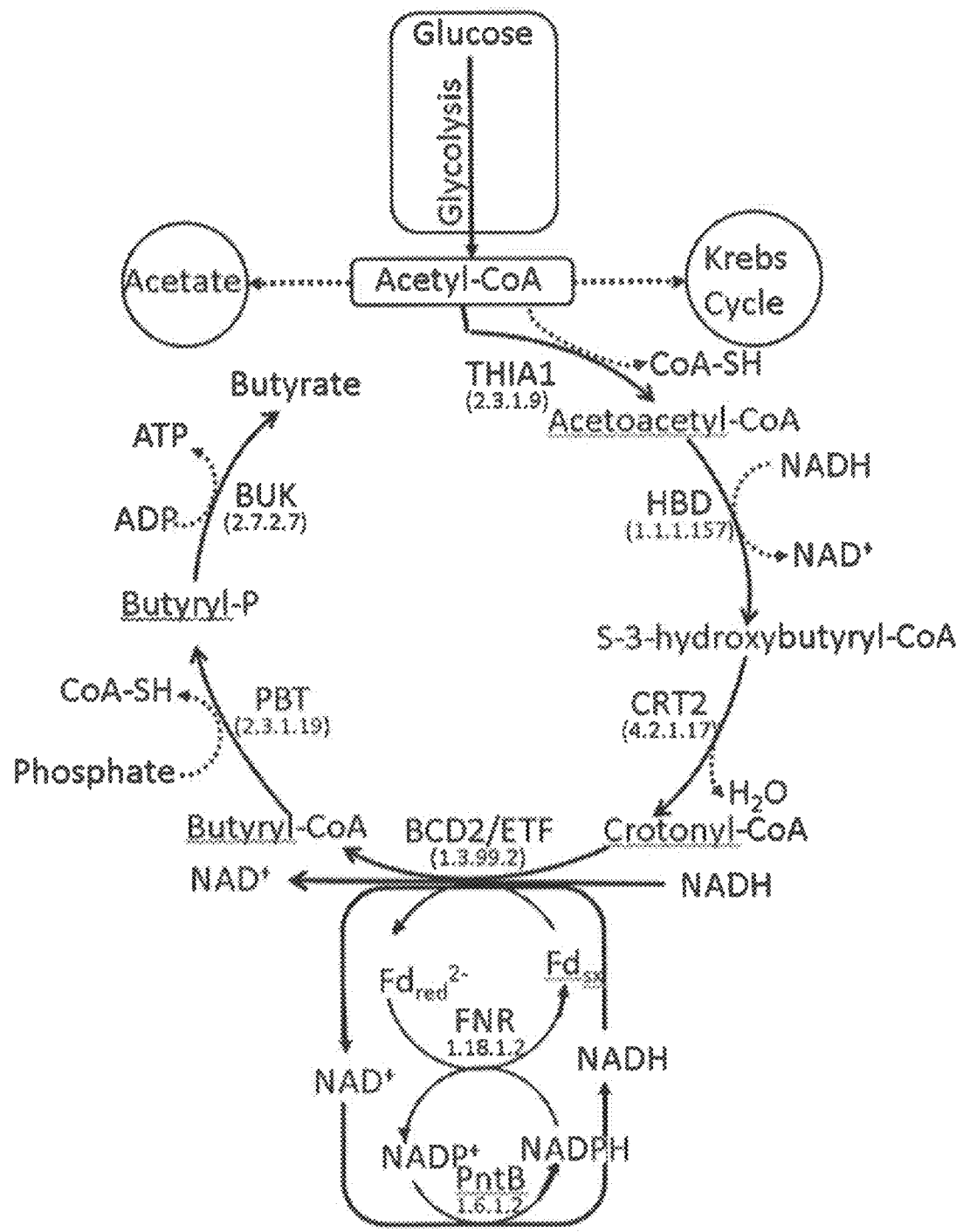
Figure 2D:
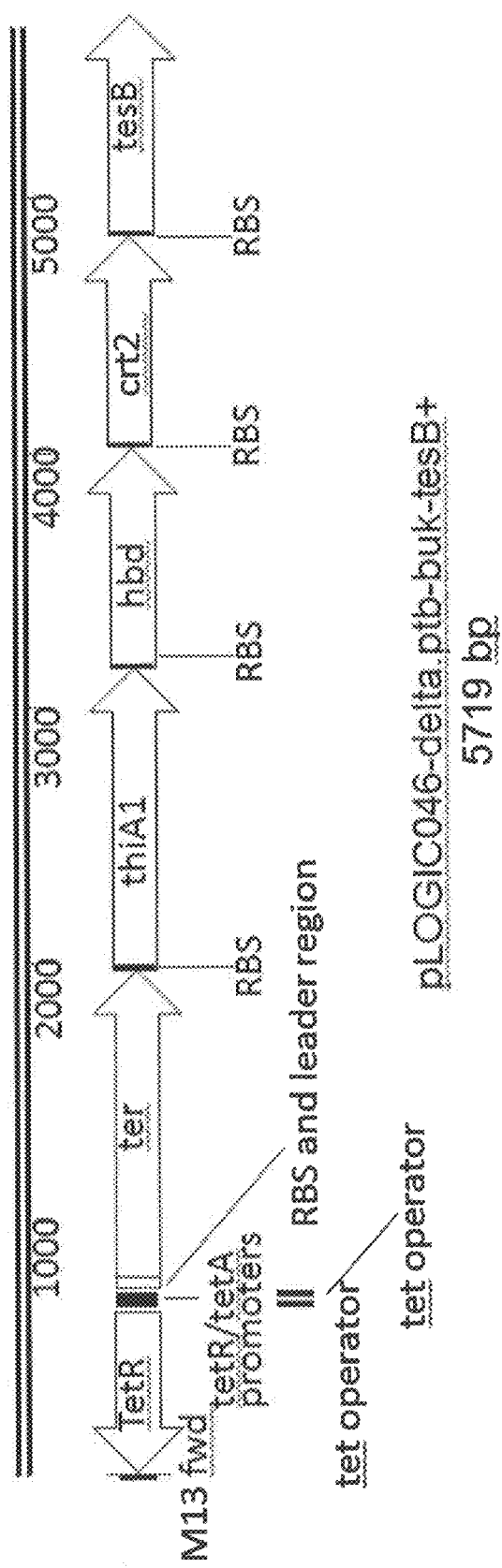
Figure 3A:
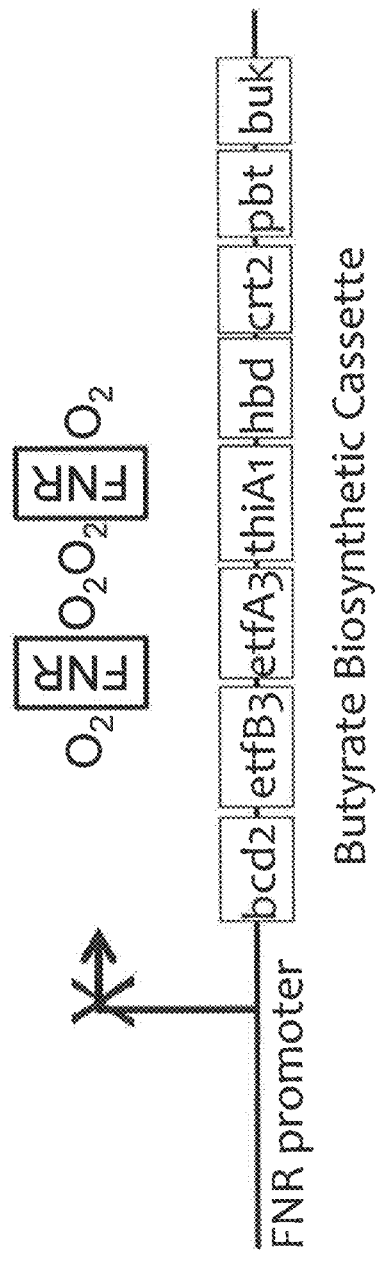
FIG. 3A, FIG. 3B, FIG. 3C, FIG. 3D, FIG. 3E, and FIG. 3F depict schematics of the gene organization of exemplary bacteria of the disclosure.
Figure 3B:
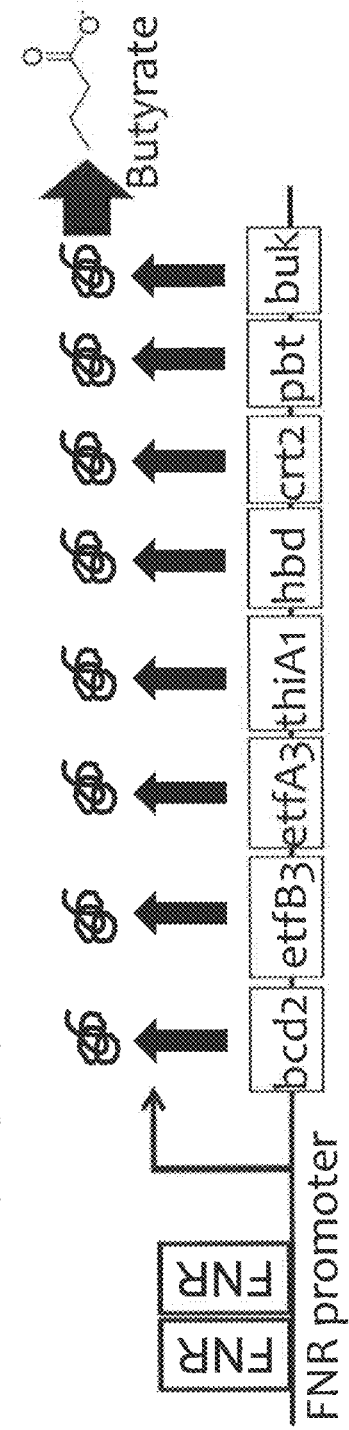
Figure 3C:
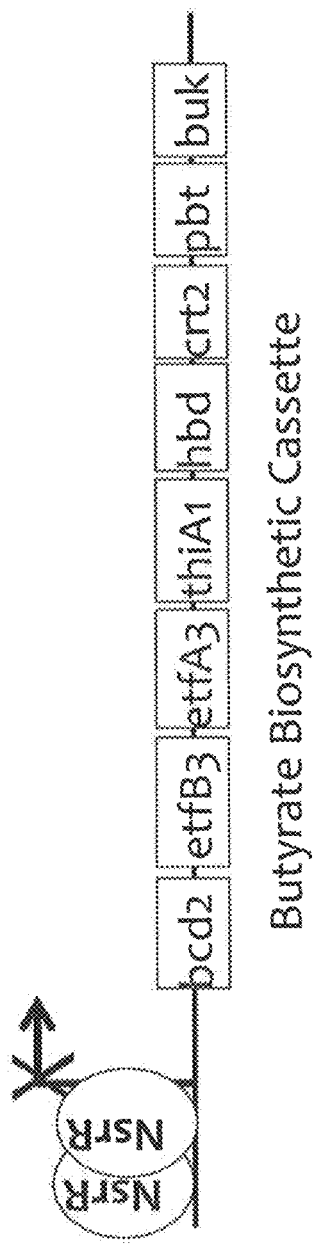
Figure 3D:
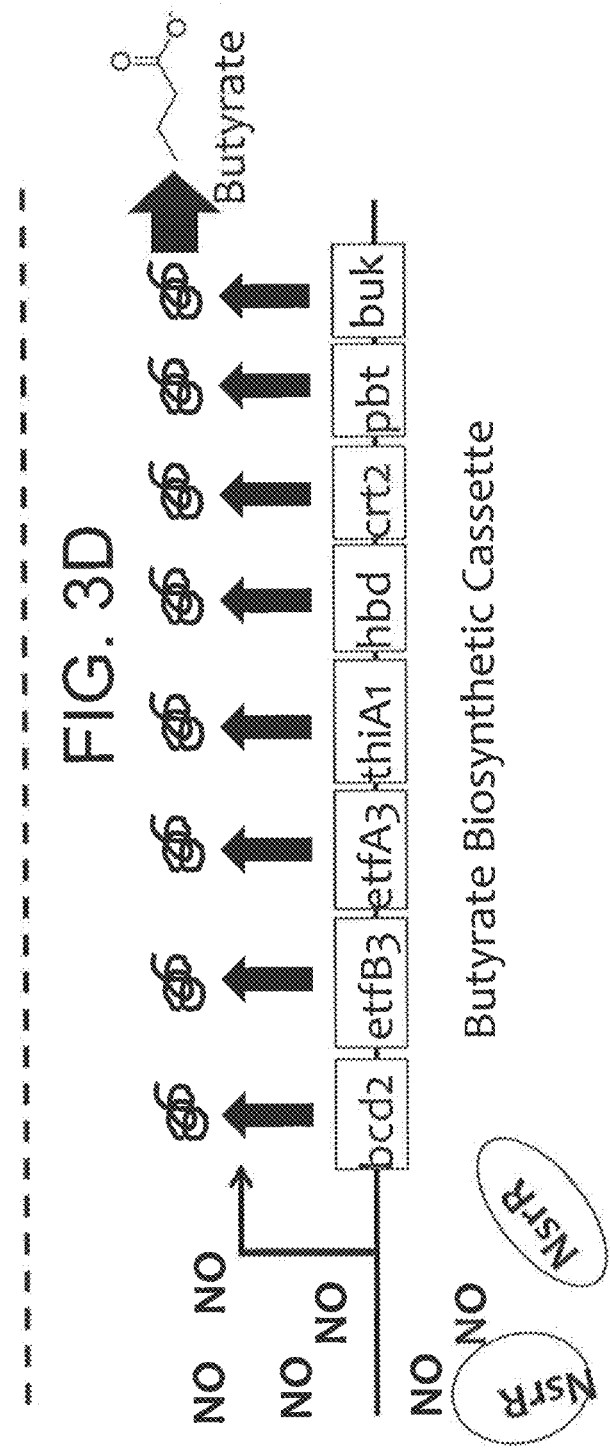
Figure 3E:
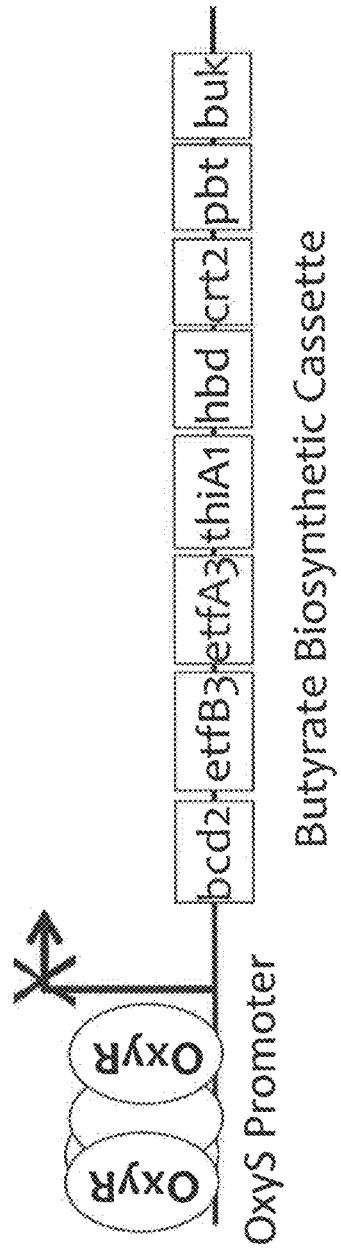
Figure 3F:
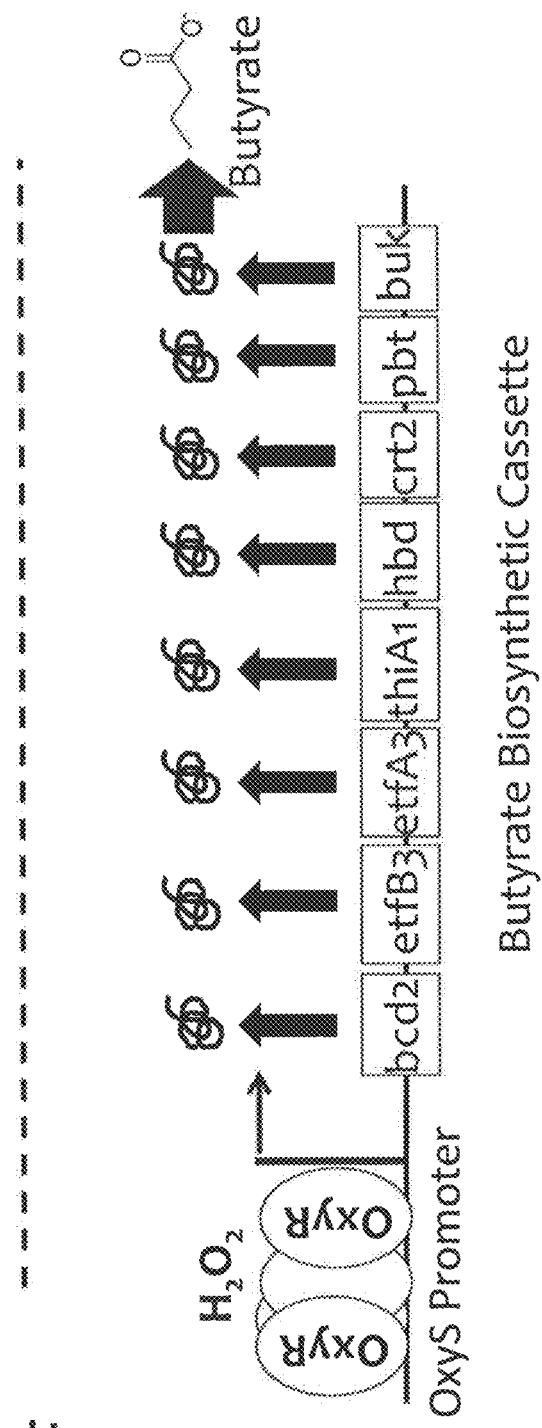
Figure 4A:
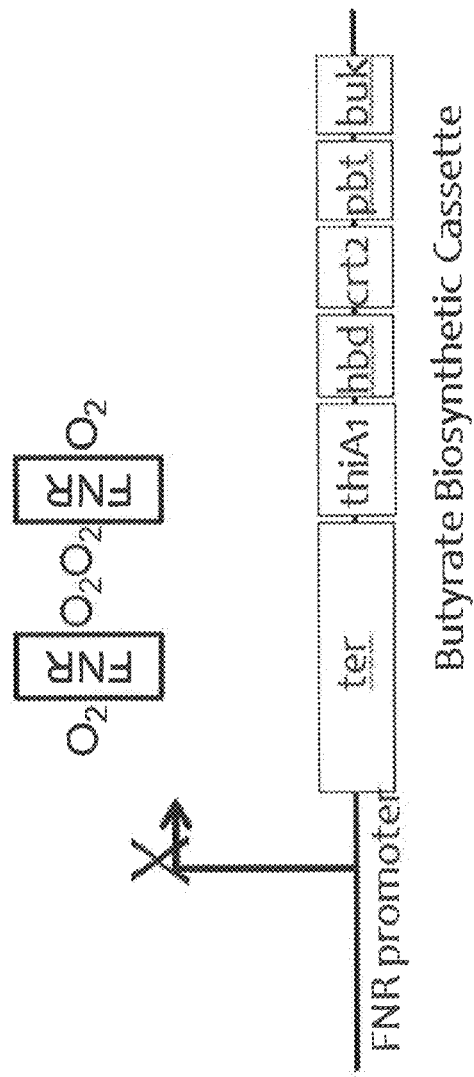
FIG. 4A, FIG. 4B, FIG. 4C, FIG. 4D, FIG. 4E, and FIG. 4F depict schematics of the gene organization of exemplary bacteria of the disclosure.
Figure 4B:
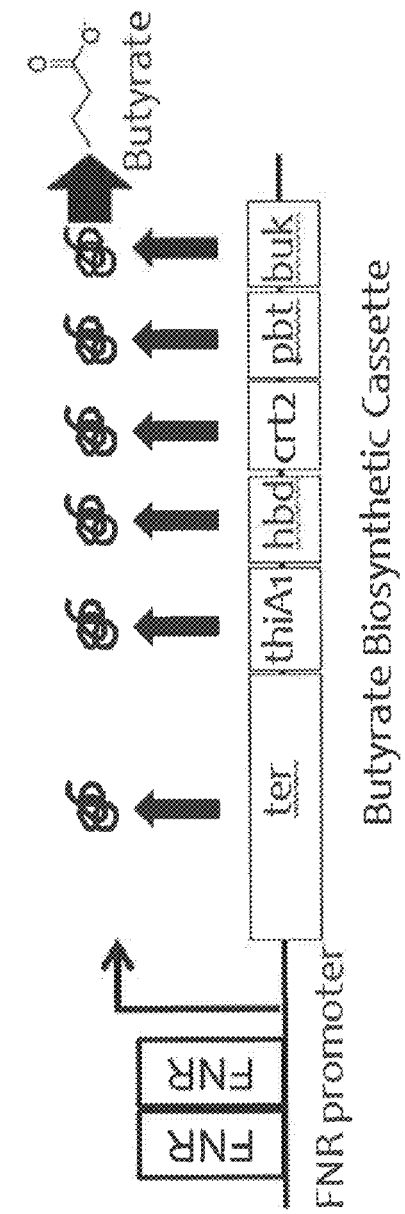
Figure 4C:
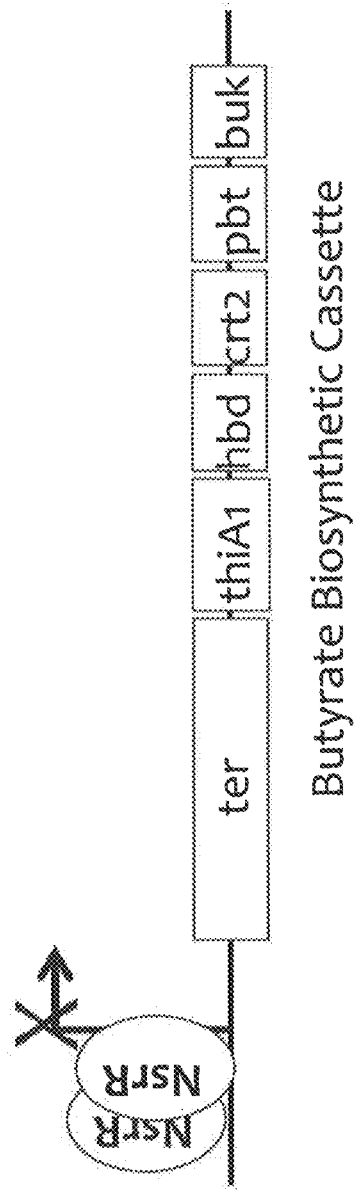
Figure 4D:
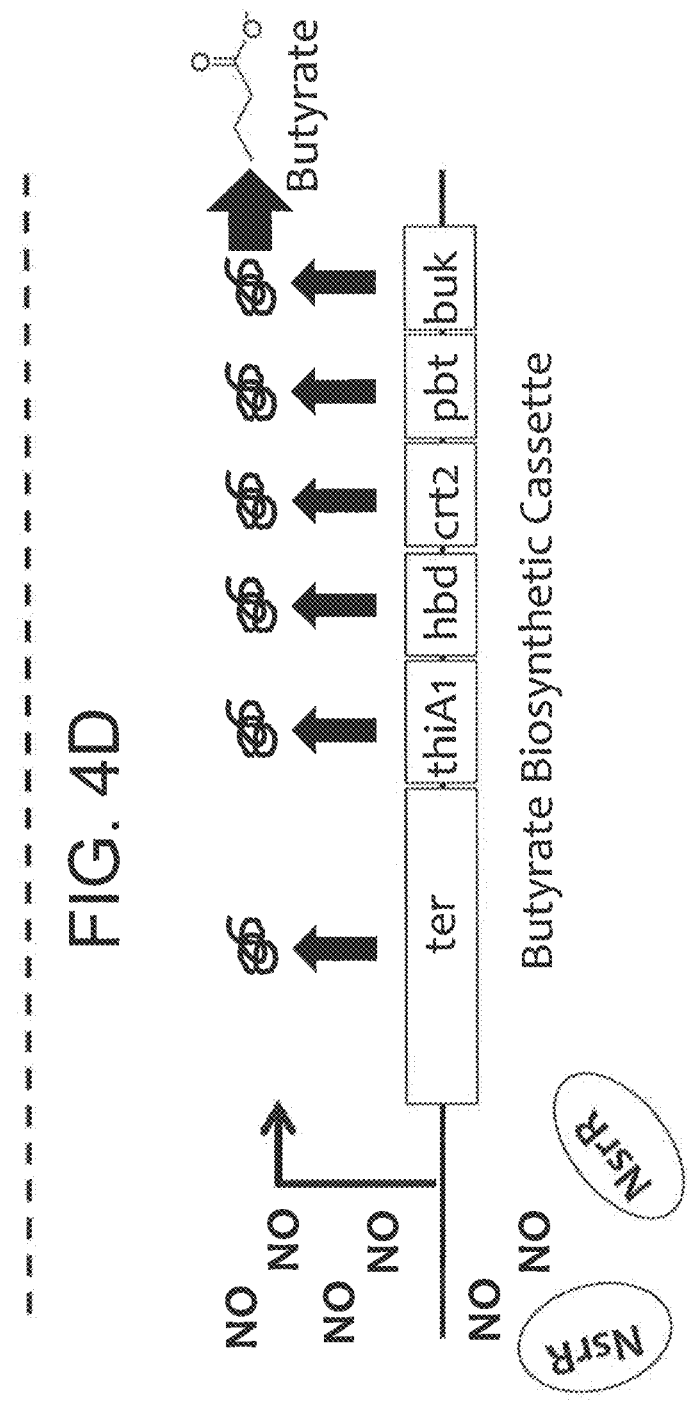
Figure 4E:
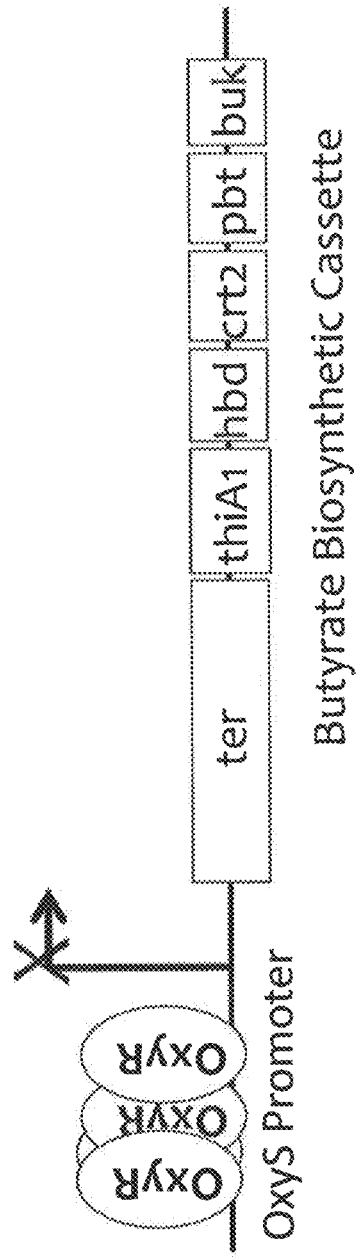
Figure 4F:
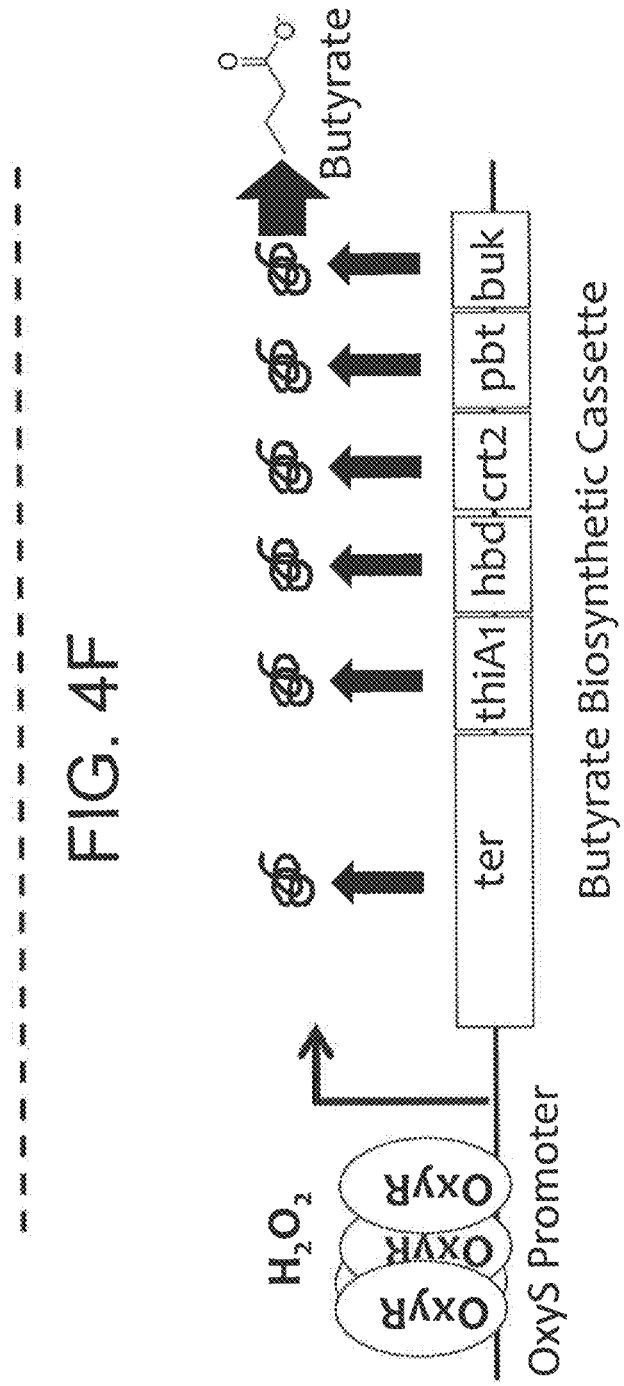
Figure 5A:
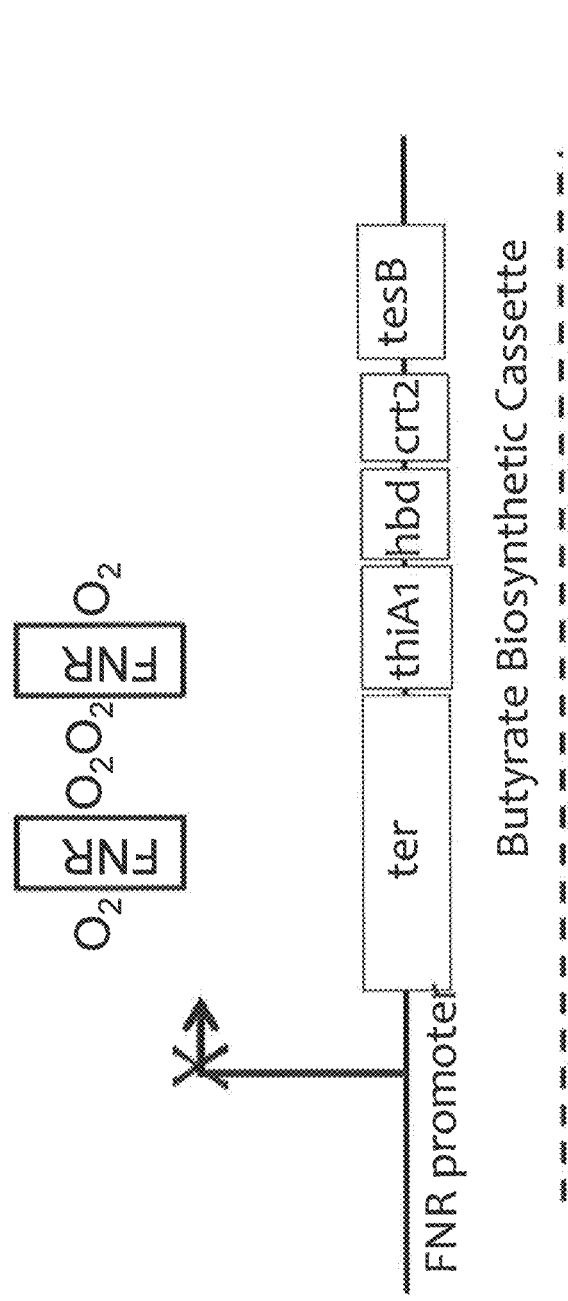
FIG. 5A, FIG. 5B, FIG. 5C, FIG. 5D, FIG. 5E, and FIG. 5F depict schematics of the gene organization of exemplary bacteria of the disclosure.
Figure 5B:
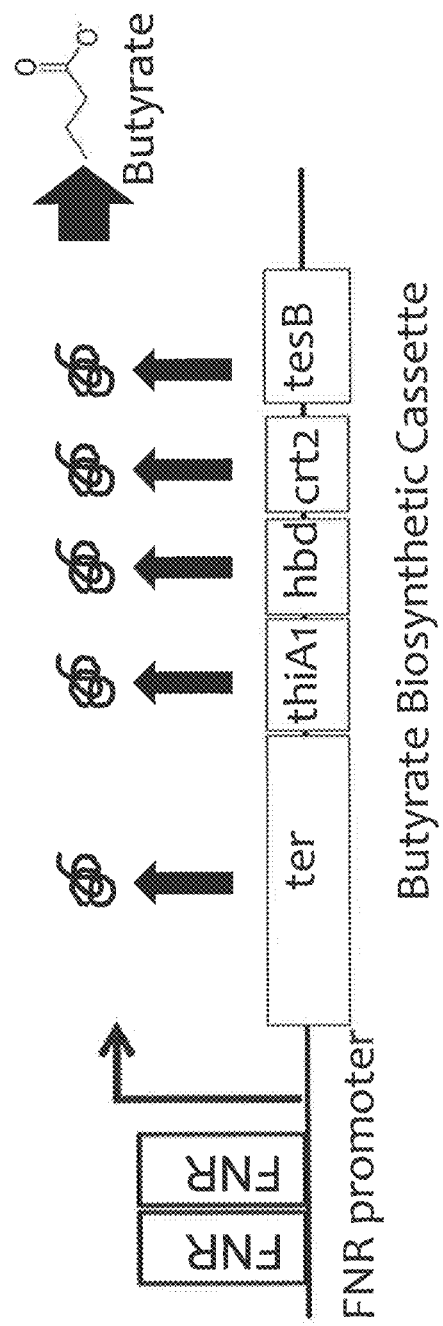
Figure 5C:
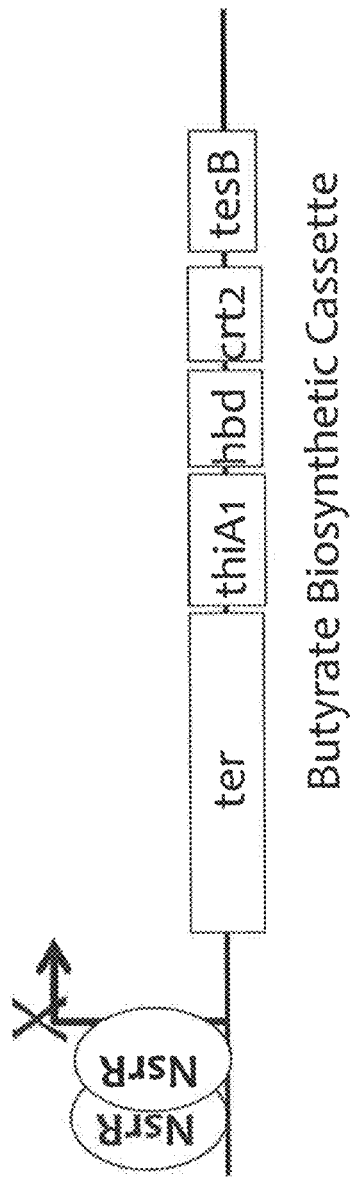
Figure 5D:
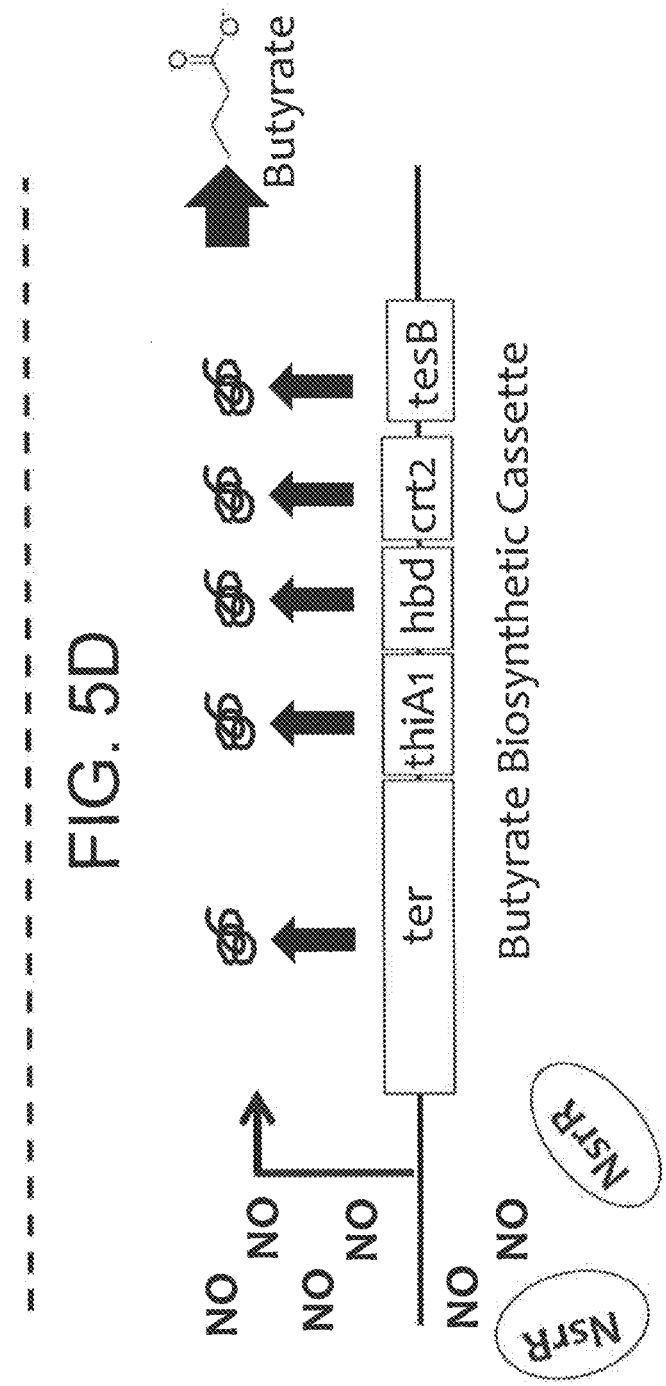
Figure 5E:
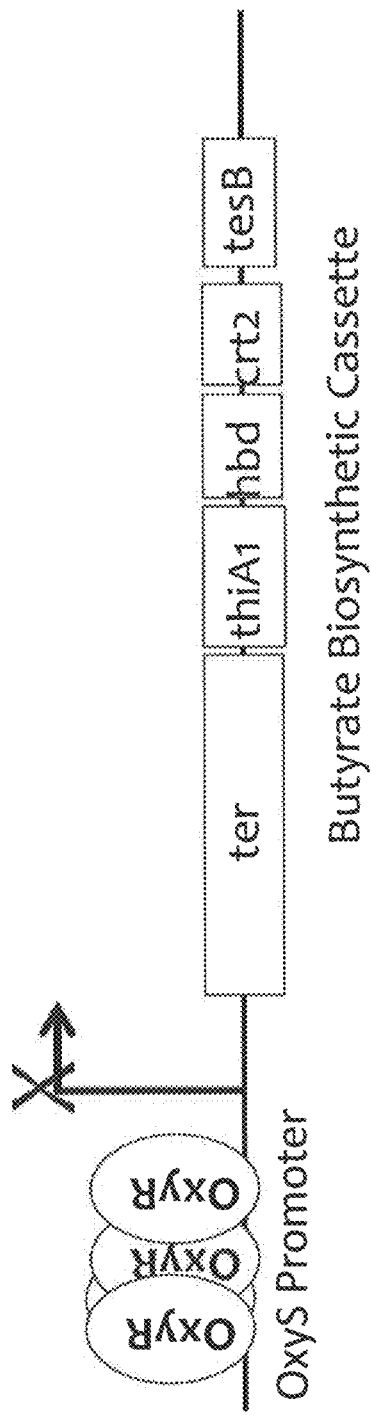
Figure 5F:
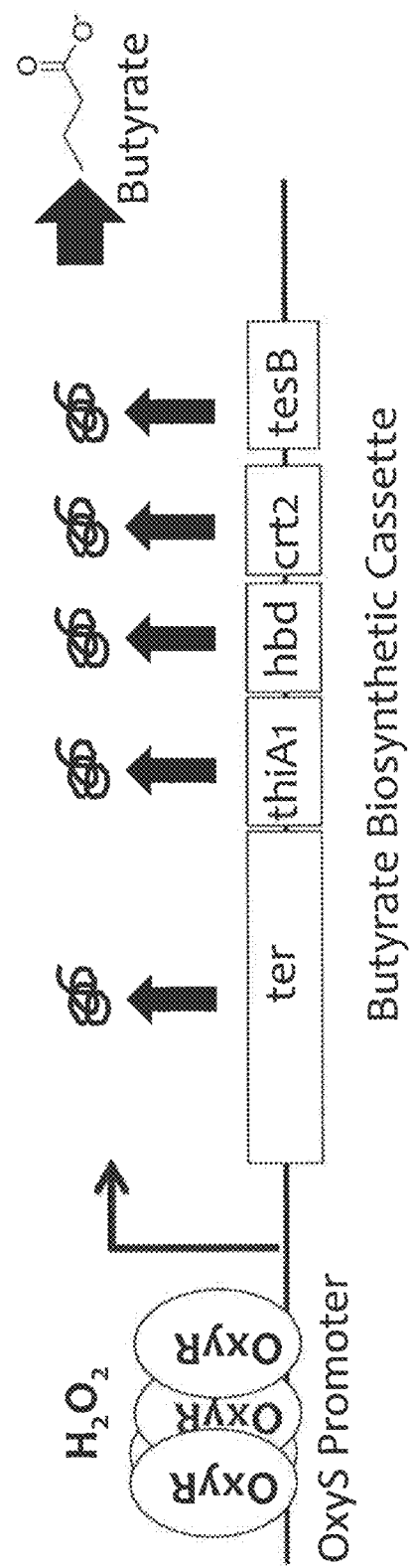
Figure 6A:
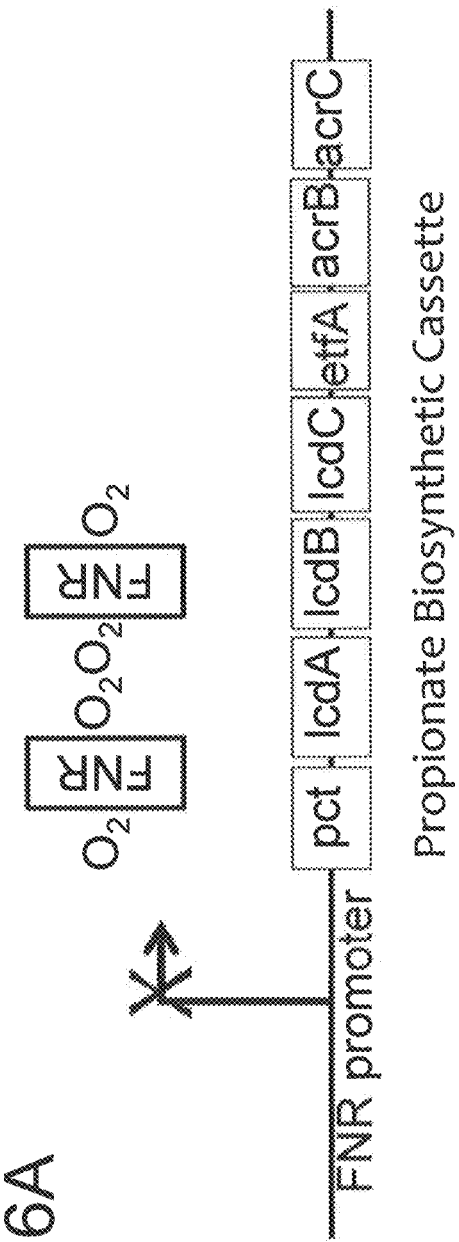
FIG. 6A and FIG. 6B depict schematics of the gene organization of exemplary bacteria of the disclosure for inducible propionate production.
Figure 6B:
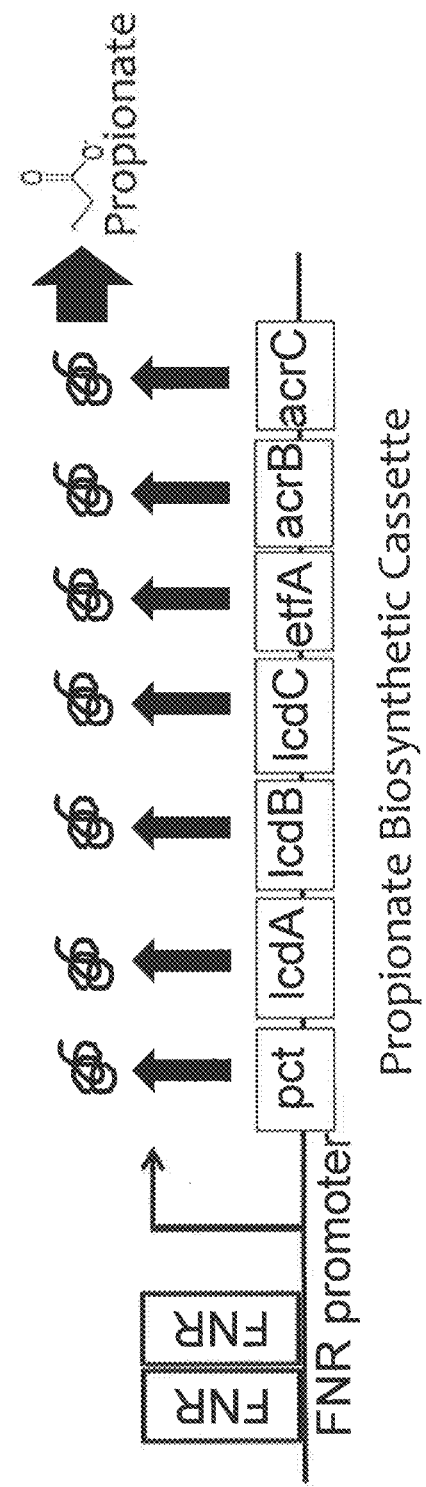
Figure 7:
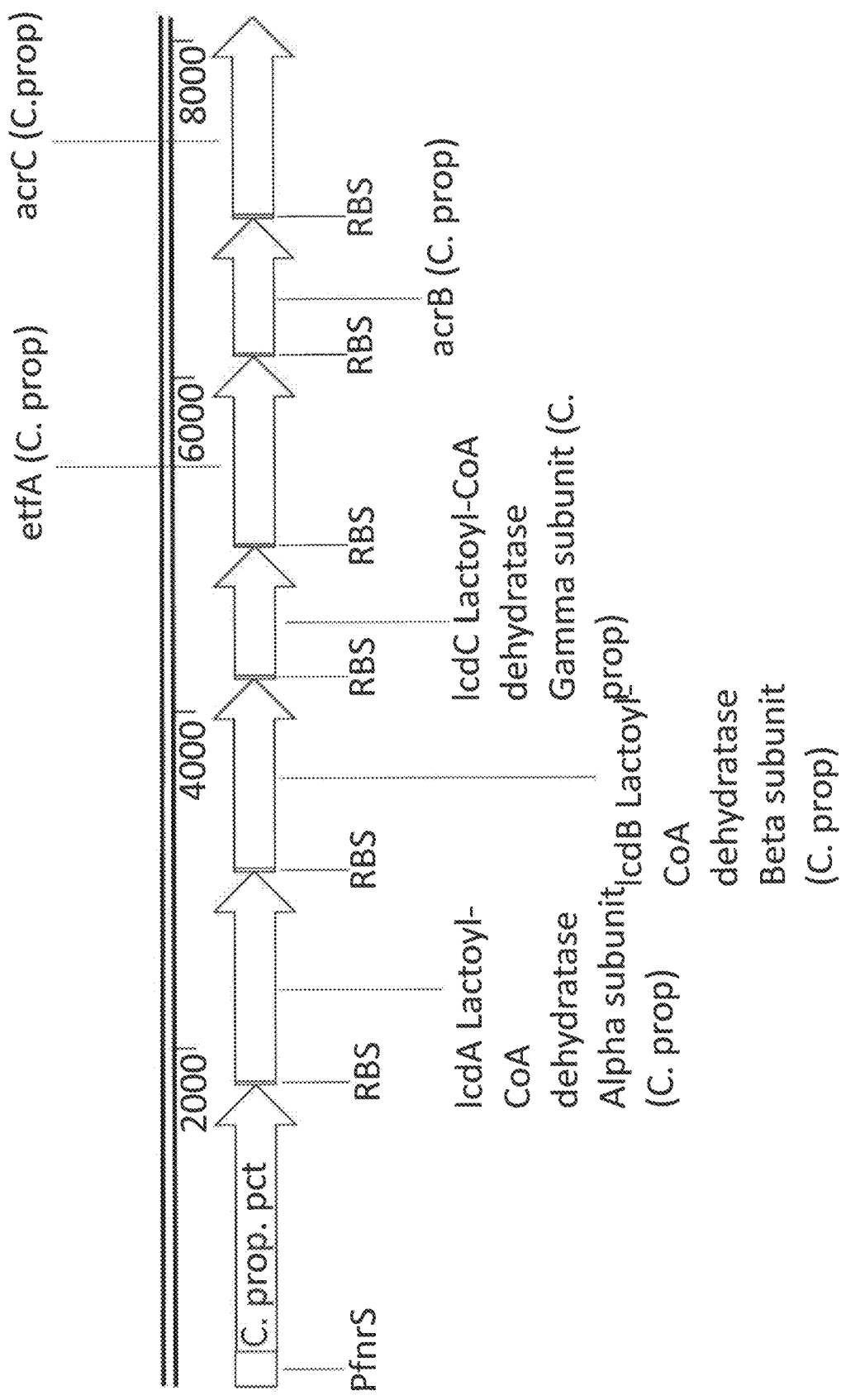
FIG. 7 depicts an exemplary propionate biosynthesis gene cassette.
Figure 8C:
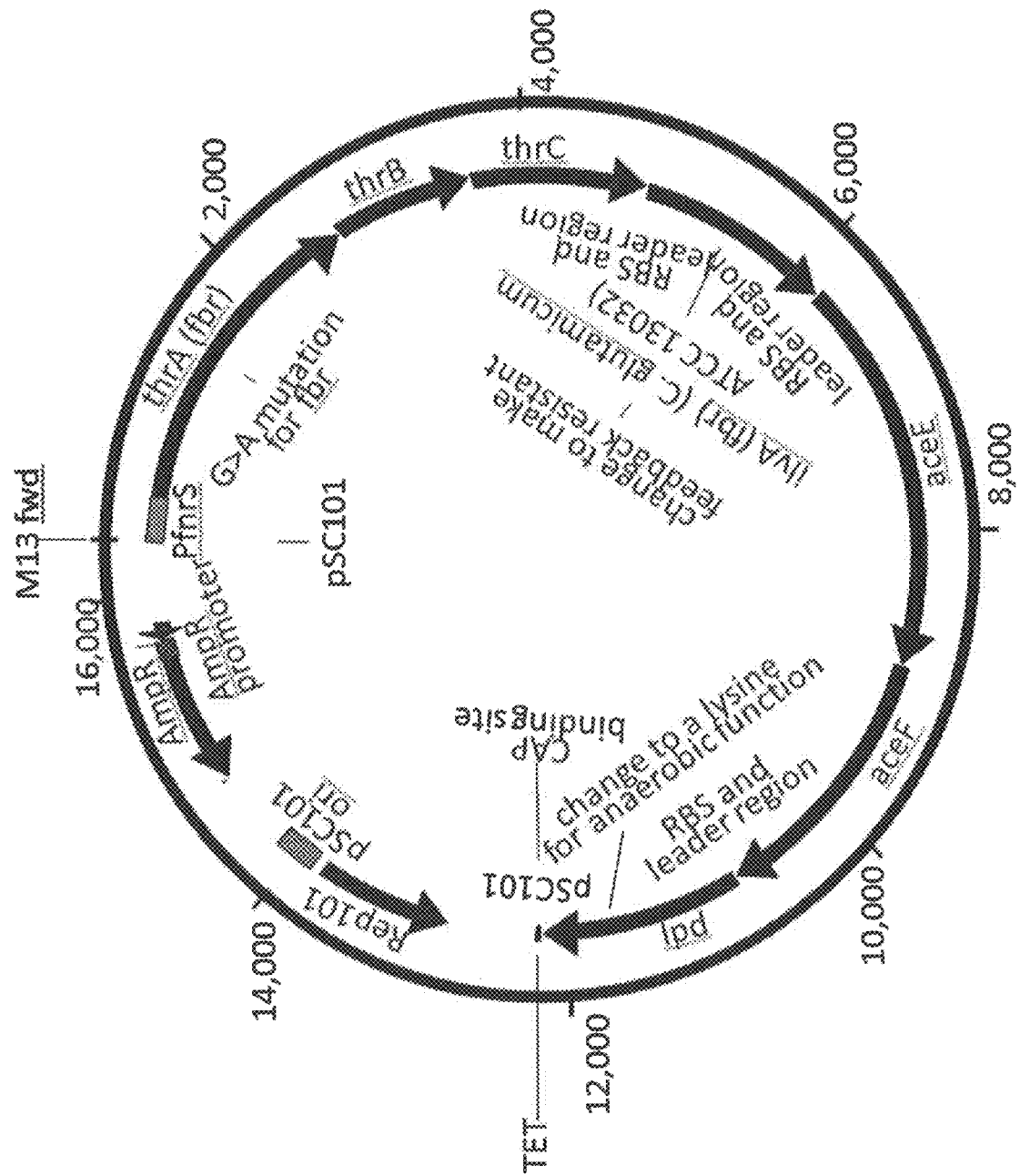
Figure 10A:
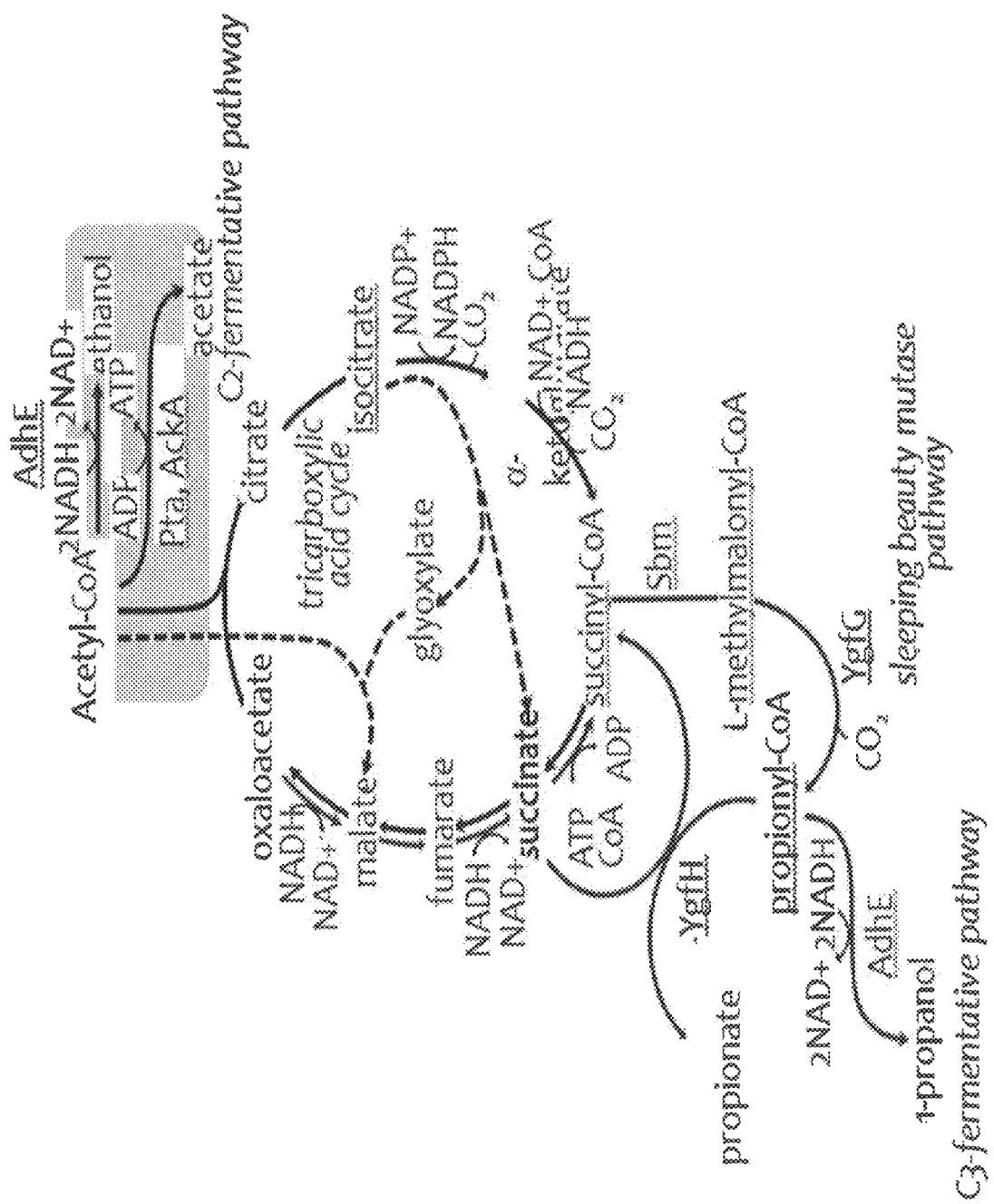
FIG. 10A, FIG. 10B, and FIG. 10C depict schematics of the sleeping beauty pathway and the gene organization of an exemplary bacterium of the disclosure.
Figure 10B:
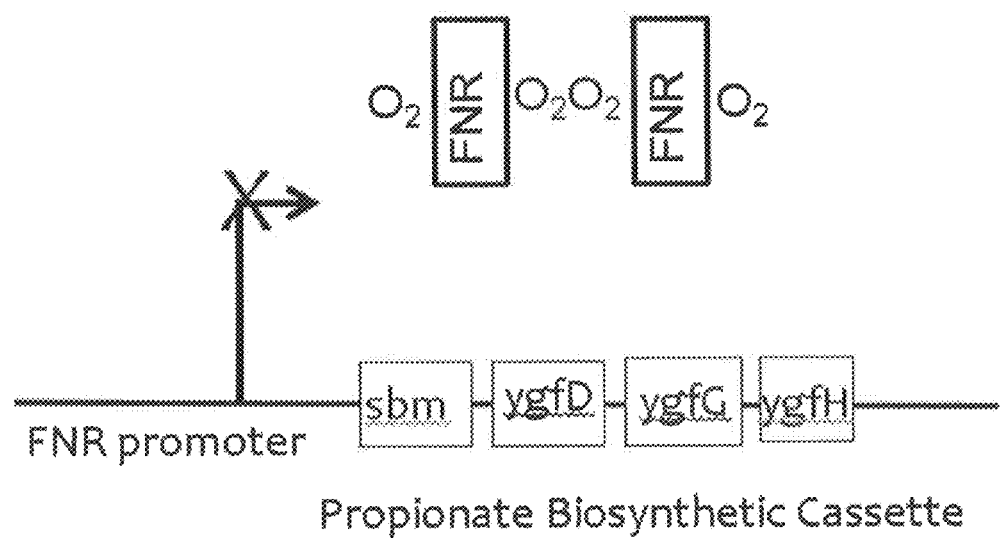
Figure 10C:
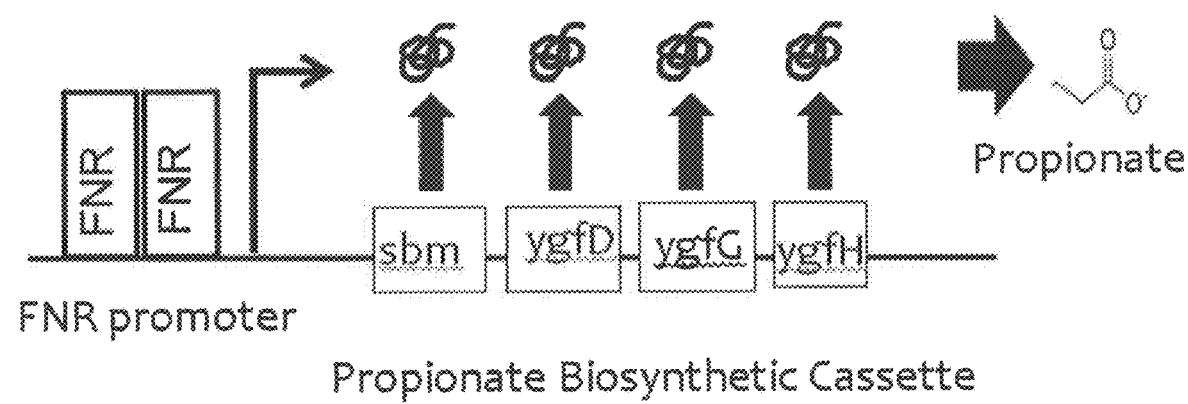

In alternate embodiments, the butyrate cassette can be inserted into the Nissle genome through homologous recombination (Genewiz, Cambridge, Mass.). Organization of the constructs and nucleotide sequences are provided herein. Organization of the constructs and nucleotide sequences are shown in FIG. 2. To create a vector capable of integrating the synthesized butyrate cassette construct into the chromosome, Gibson assembly was first used to add 1000 bp sequences of DNA homologous to the Nissle lacZ locus into the R6K origin plasmid pKD3. This targets DNA cloned between these homology arms to be integrated into the lacZ locus in the Nissle genome. Gibson assembly was used to clone the fragment between these arms. PCR was used to amplify the region from this plasmid containing the entire sequence of the homology arms, as well as the butyrate cassette between them. This PCR fragment was used to transform electrocompetent Nissle-pKD46, a strain that contains a temperature-sensitive plasmid encoding the lambda red recombinase genes. After transformation, cells were grown out for 2 hours before plating on chloramphenicol at 20 ug/mL at 37 degrees C. Growth at 37 degrees C. also cures the pKD46 plasmid. Transformants containing cassette were chloramphenicol resistant and lac-minus (lac-).

Example 4

Production of Butyrate in Recombinant *E. coli* Using Tet-Inducible Promoter

Production of butyrate was assessed in *E. coli* Nissle strains containing butyrate cassettes described above in order to determine the effect of oxygen on butyrate production. The tet-inducible cassettes tested include (1) tet-butyrate cassette comprising all eight genes (pLOGIC031); (2) tet-butyrate cassette in which the ter is substituted (pLOGIC046) and (3) tet-butyarte cassette in which tesB is substituted in place of pbt and buk genes.

All incubations are performed at 37° C. Cultures of *E. coli* strains DH5a and Nissle transformed with the butyrate cassettes are grown overnight in LB and then diluted 1:200 into 4 mL of M9 minimal medium containing 0.5% glucose. The cells were grown with shaking (250 rpm) for 4-6 h and incubated aerobically or anaerobically in a Coy anaerobic chamber (supplying 90% $N_2$, 5% $CO_2$, 5% $H_2$). One mL culture aliquots were prepared in 1.5 mL capped tubes and incubated in a stationary incubator to limit culture aeration. One tube is removed at each time point (0, 1, 2, 4, and 20 hours) and analyzed for butyrate concentration by LC-MS to confirm that butyrate production in these recombinant strains can be achieved in a low-oxygen environment.

Figure 11:
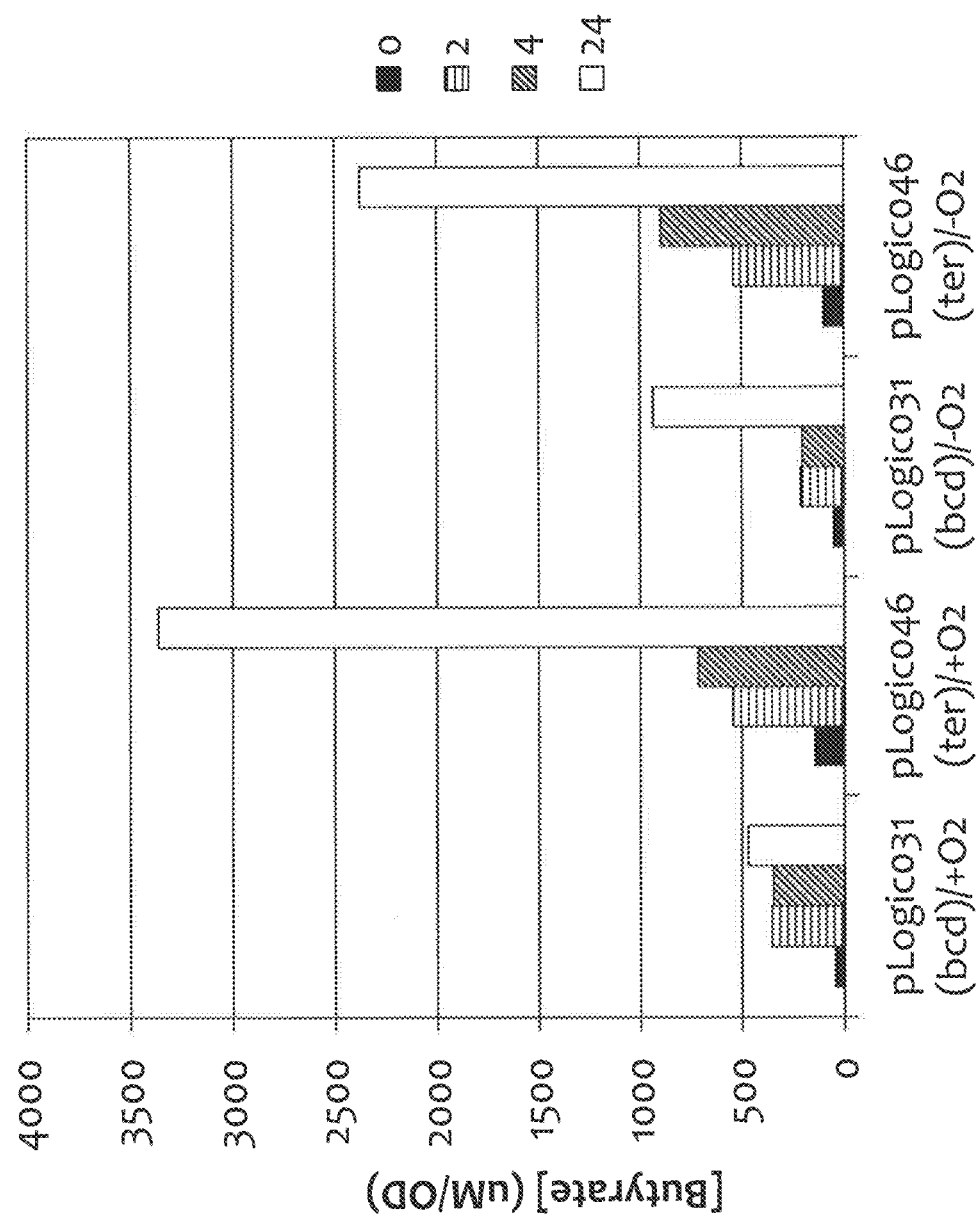
FIG. 11 depicts a bar graph showing butyrate production of butyrate producing strains of the disclosure.
Figure 12:
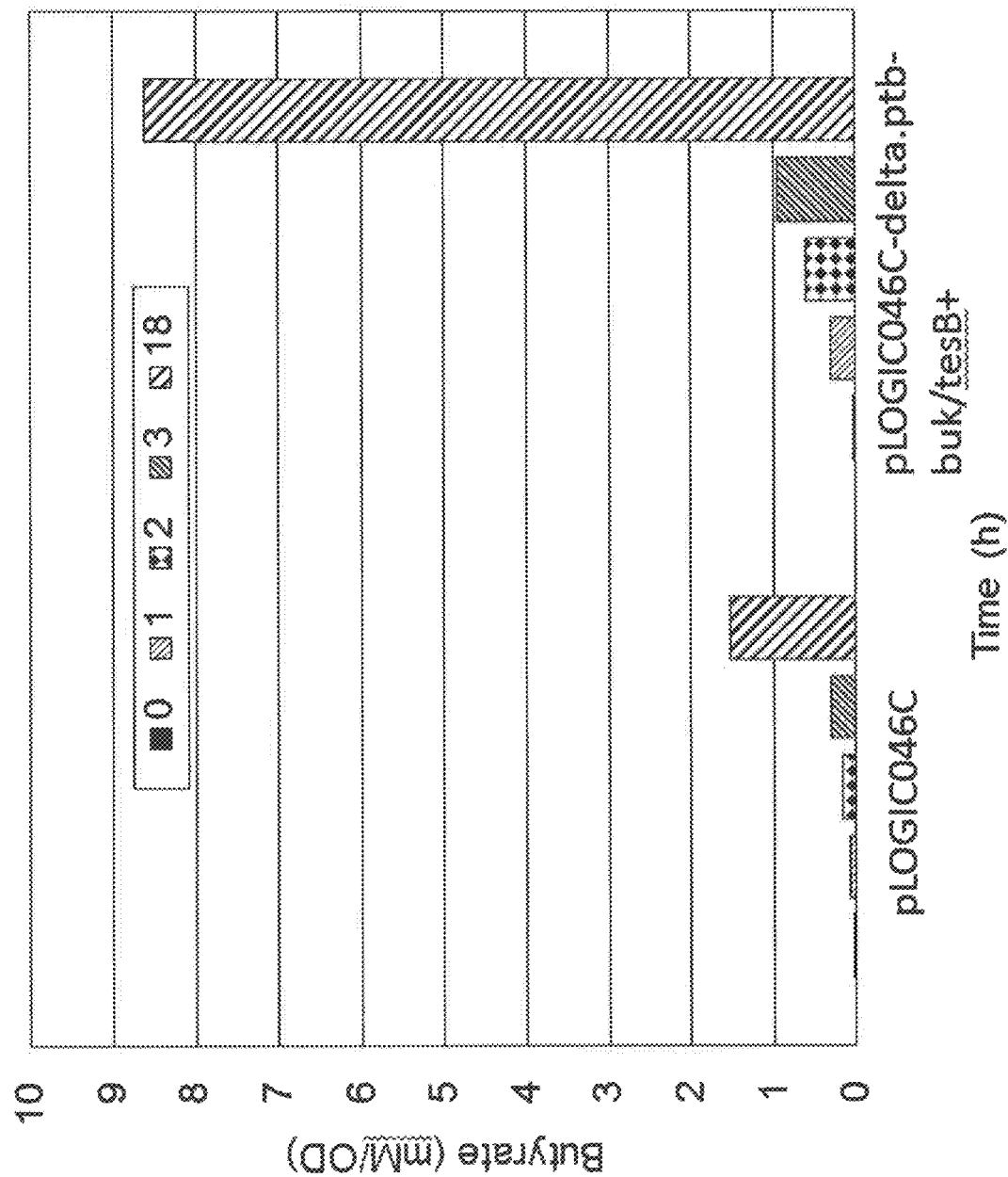
FIG. 12 depicts a bar graph showing butyrate production of butyrate producing strains of the disclosure.

FIG. 11 depicts bar graphs of butyrate production using the different butyrate-producing circuits shown in FIG. 2.

FIG. 11A shows butyrate production in strains pLOGIC031 and pLOGIC046 in the presence and absence of oxygen, in which there is no significant difference in butyrate production. Enhanced butyrate production was shown in Nissle in low copy plasmid expressing pLOGIC046 which contain a deletion of the final two genes (ptb-buk) and their replacement with the endogenous *E. Coli* tesB gene (a thioesterase that cleaves off the butyrate portion from butyryl CoA).

Example 5

Tet-Driven and RNS Driven In Vitro Butyrate Production in Recombinant *E. coli*

Figure 21:
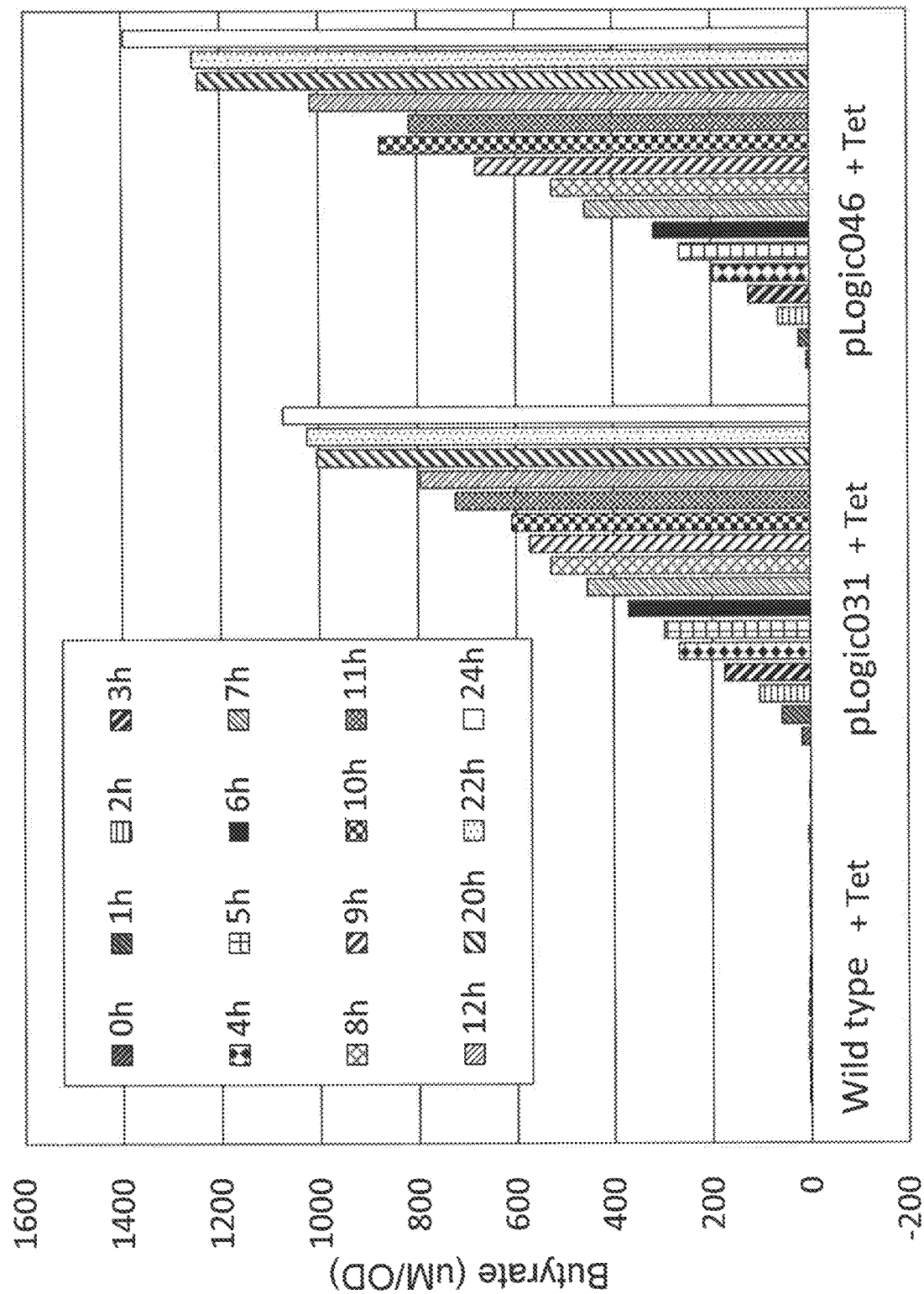
FIG. 21 depicts butyrate production using SYN001+tet (control wild-type Nissle comprising no plasmid), SYN067+tet (Nissle comprising the pLOGIC031 ATC-inducible butyrate plasmid), and SYN080+tet (Nissle comprising the pLOGIC046 ATC-inducible butyrate plasmid).

All incubations were performed at 37° C. Lysogeny broth (LB)-grown overnight cultures of *E. coli* Nissle transformed with pLogic031 or pLogic046 were subcultured 1:100 into 10 mL of M9 minimal medium containing 0.5% glucose and grown shaking (200 rpm) for 2 h, at which time anhydrous tetracycline (ATC) was added to cultures at a concentration of 100 ng/mL to induce expression the butyrate operon from pLogic031 or pLogic046. After 2 hours of induction, cells were spun down, supernatant was discarded, and the cells were resuspended in M9 minimal media containing 0.5% glucose. Culture supernatant was then analyzed at indicated time points ((0 up to 24 hours, as shown in FIG. 21) to assess levels of butyrate production by LC-MS. As seen in FIG. 21 butyrate production is greater in the strain comprising the pLogic046 construct than the strain comprising the pLogic031 construct.

Figure 22:
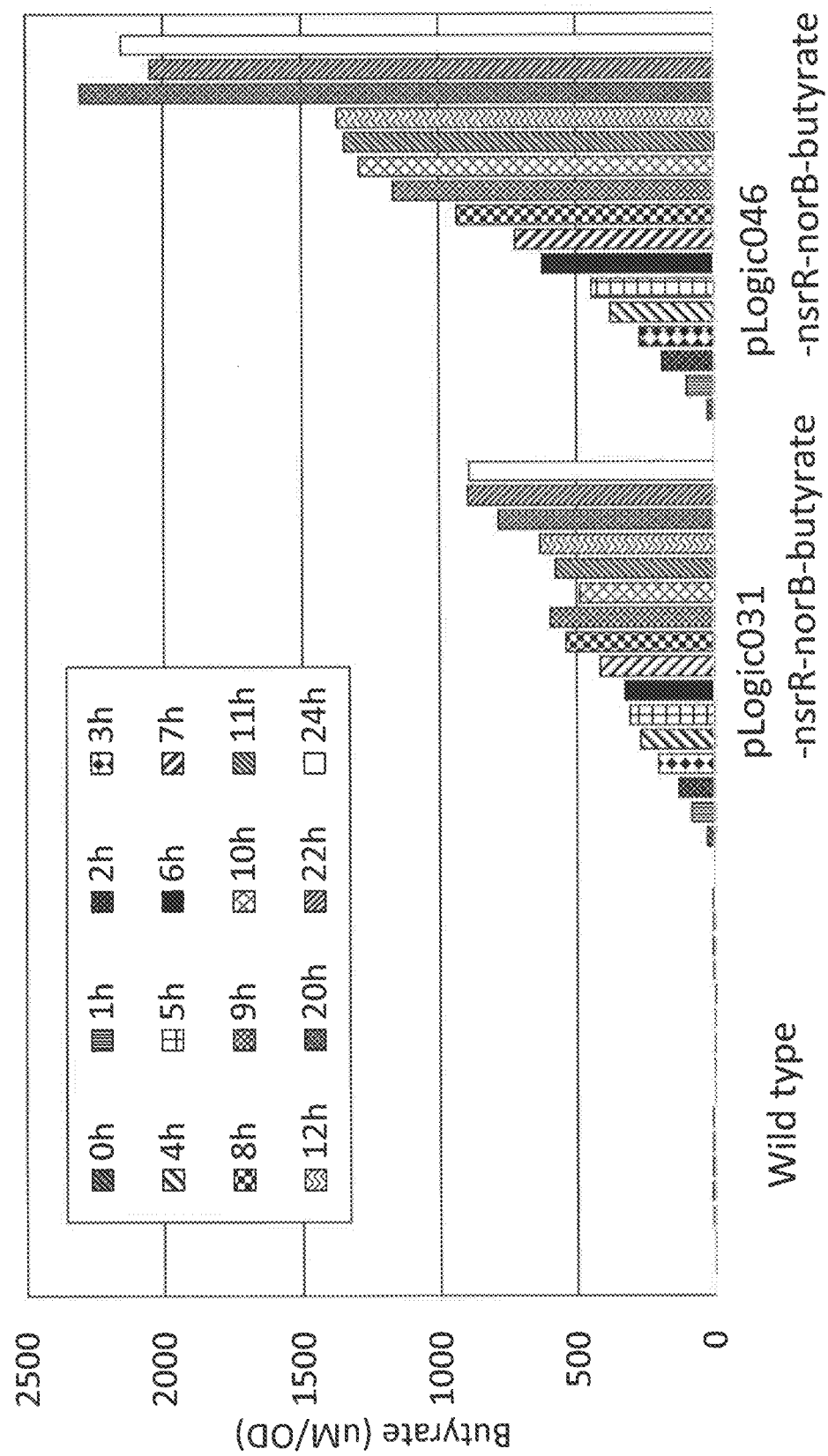
FIG. 22 depicts butyrate production by genetically engineered Nissle comprising the pLogic031-nsrR-norB-butyrate construct (SYN133) or the pLogic046-nsrR-norB-butyrate construct (SYN145), which produce more butyrate as compared to wild-type Nissle (SYN001).
Figure 23:
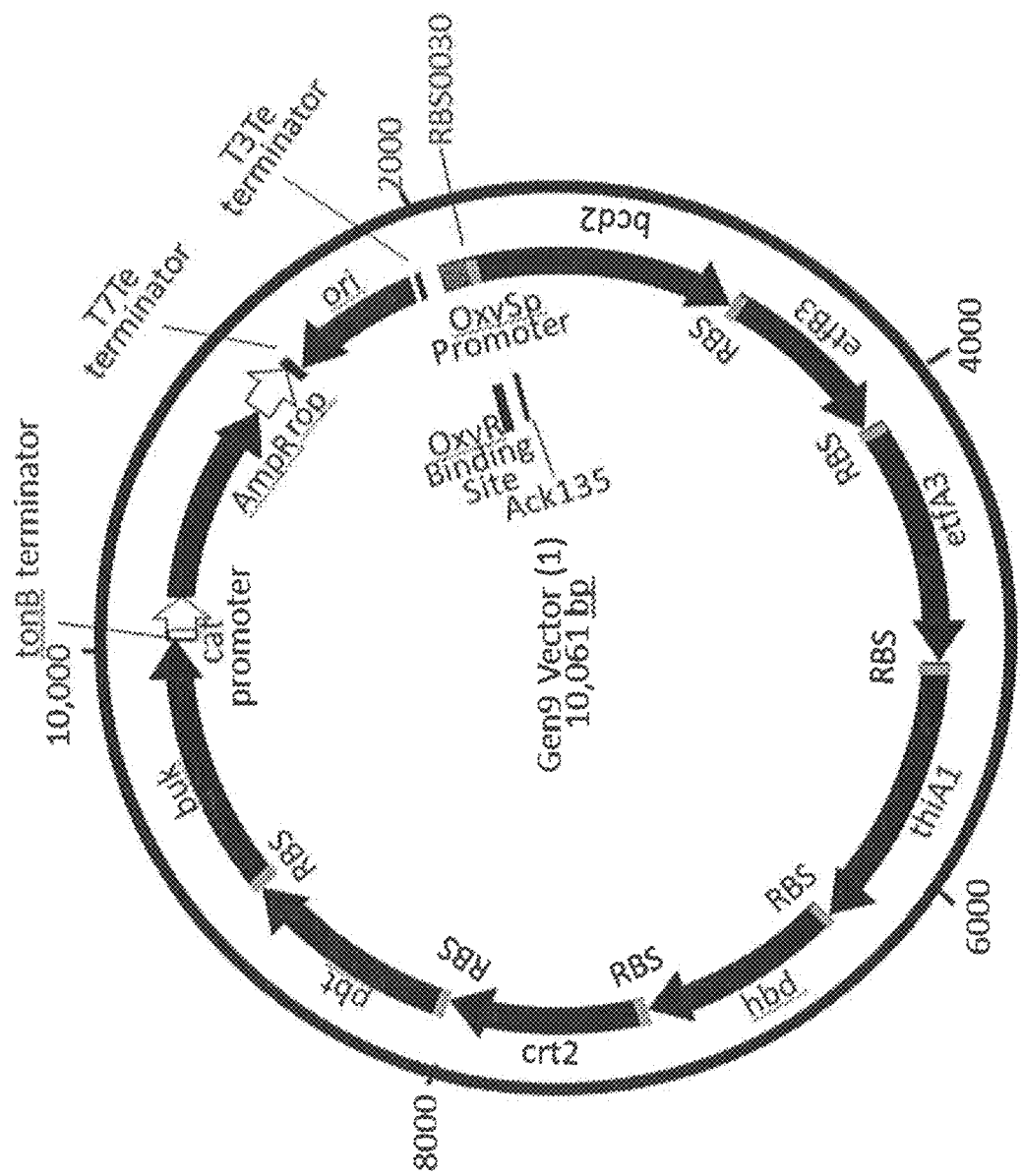
FIG. 23 depicts the construction and gene organization of an exemplary plasmid comprising an oxyS promoter and butyrogenic gene cassette (pLogic031-oxyS-butyrogenic gene cassette).
Figure 24:
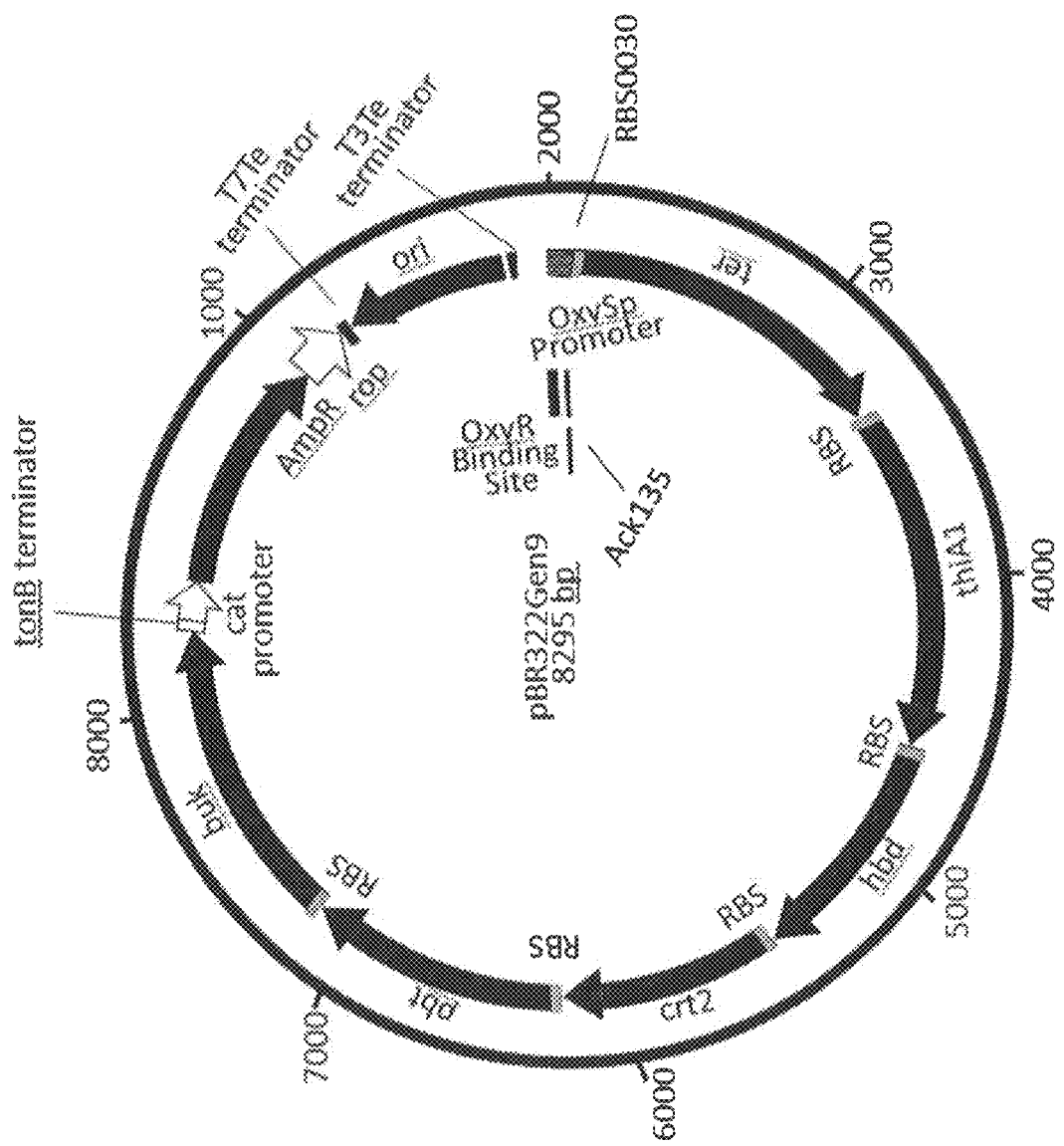
FIG. 24 depicts the construction and gene organization of another exemplary plasmid comprising an oxyS promoter and butyrogenic gene cassette (pLogic046-oxyS-butyrogenic gene cassette).

Production of butyrate was also assessed in *E. coli* Nissle strains containing the butyrate cassettes driven by an RNS promoter described above (pLogic031-nsrR-norB-butyrate operon construct and pLogic046-nsrR-norB-butyrate operon construct) in order to determine the effect of nitrogen on butyrate production. Overnight bacterial cultures were diluted 1:100 into fresh LB and grown for 1.5 hrs to allow entry into early log phase. At this point, long half-life nitric oxide donor (DETA-NO; diethylenetriamine-nitric oxide adduct) was added to cultures at a final concentration of 0.3 mM to induce expression from plasmid. After 2 hours of induction, cells were spun down, supernatant was discarded, and the cells were resuspended in M9 minimal media containing 0.5% glucose. Culture supernatant was then analyzed at indicated time points (0 up to 24 hours, as shown in FIG. 22) to assess levels of butyrate production. As seen in FIG. 22, genetically engineered Nissle comprising pLogic031-nsrR-norB-butyrate operon construct) or (pLogic046-nsrR-norB-butyrate operon construct) produced significantly more butyrate as compared to wild-type Nissle.

Example 6

In Vitro Production of Butyrate in Recombinant *E. coli* Using an Inducible Tet Promoter Butyrate Circuit NuoB is a protein complex involved in the oxidation of NADH during respiratory growth (form of growth requiring electron transport). Preventing the coupling of NADH oxidation to electron transport allows an increase in the amount of NADH being used to support butyrate production. To test whether Preventing the coupling of NADH oxidation to electron transport would allow increased butyrate production, NuoB mutants having NuoB deletion were obtained.

Figure 13:
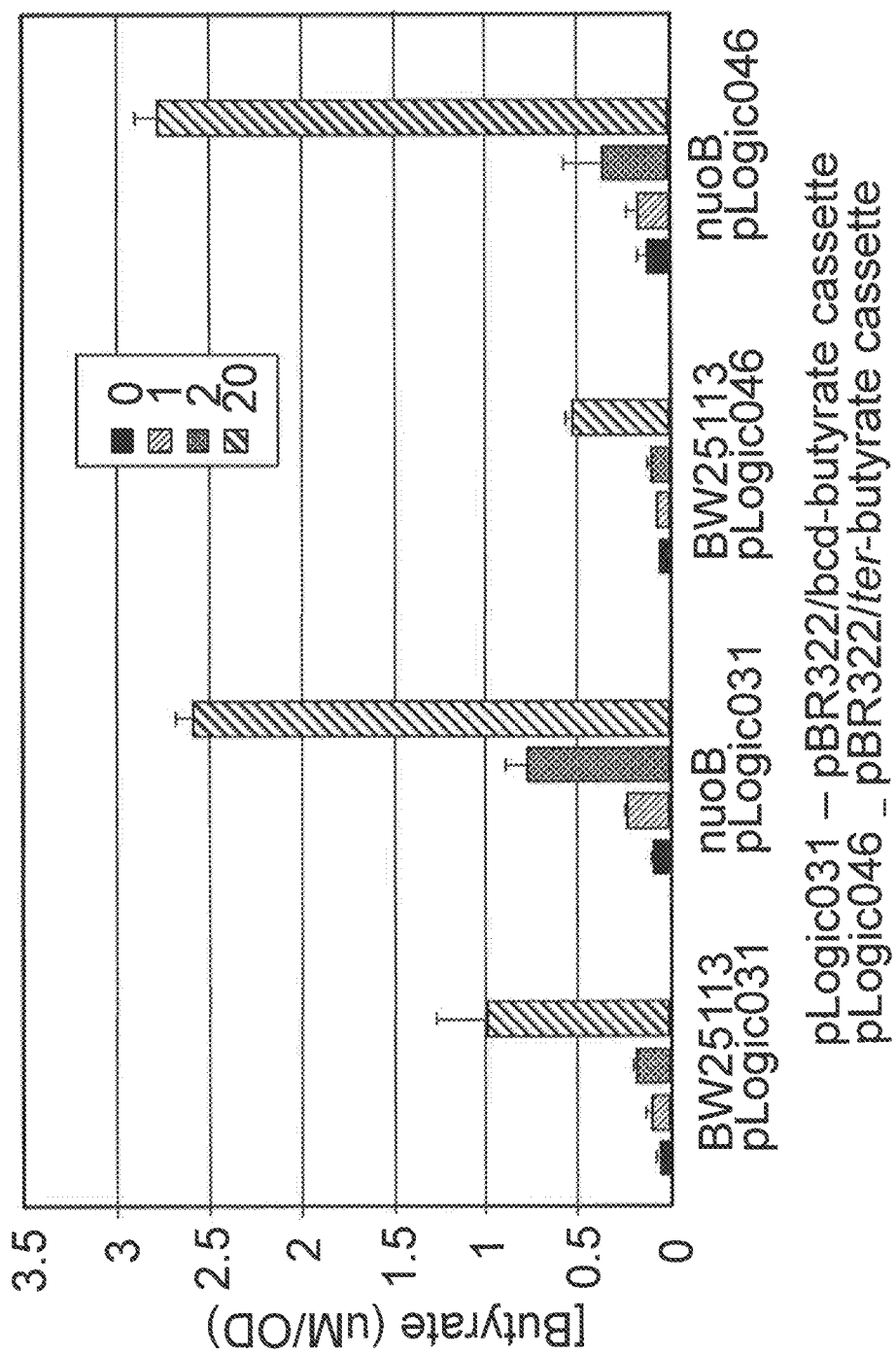
FIG. 13 depicts a graph of butyrate production using different butyrate-producing circuits comprising a nuoB gene deletion. Strains depicted are BW25113 comprising a bcd-butyrate cassette, with or without a nuoB deletion, and BW25113 comprising a ter-butyrate cassette, with or without a nuoB deletion. Strains with deletion are labeled with nuoB. The NuoB gene deletion results in greater levels of butyrate production as compared to a wild-type parent control in butyrate producing strains. NuoB is a main protein complex involved in the oxidation of NADH during respiratory growth. In some embodiments, preventing the coupling of NADH oxidation to electron transport increases the amount of NADH being used to support butyrate production.

All incubations were performed at 37° C. Lysogeny broth (LB)-grown overnight cultures of *E. coli* strains DH5a and Nissle containing pLogic031 or pLogic046 were subcultured 1:100 into 10 mL of M9 minimal medium containing 0.2% glucose and grown shaking (200 rpm) for 2 h, at which time anhydrous tetracycline (ATC) was added to cultures at a concentration of 100 ng/mL to induce expression the butyrate operon from pLogic031 or pLogic046. Cultures were incubated either shaking in flasks ($+O_2$) or in the anaerobic chamber ($-O_2$) and samples were removed, and butyrate was quantitated at 2, 4, and 24 hr via LC-MS. See FIG. 13, which depicts a graph of butyrate production using different butyrate-producing circuits comprising a nuoB gene deletion. FIG. 13 shows the BW25113 strain of *E. Coli*, which is a common cloning strain and the background of the KEIO collection of *E. Coli* mutants. FIG. 13 shows that compared with wild-type Nissle, deletion of NuoB results in greater production of butyrate.

Example 7

Production of Butyrate in Recombinant *E. coli*

In vitro production of butyrate under the control of a tetracycline promoter was compared between (1) Butyrate gene cassette (pLOGIC046-ter-thiA1-hbd-crt2-pbt buk butyrate) and (2) butyrate cassette in which the pbt and buk genes were placed with tesB (pLOGIC046-deltapbt-buk/tesB+-butyrate; SEQ ID NO: 56).

Overnight bacterial cultures were diluted 1:100 into fresh LB and grown for 1.5 hrs to allow entry into early log phase. At this point, anhydrous tetracycline (ATC) was added to cultures at a final concentration of 100 ng/mL to induce expression of butyrate genes from plasmid. After 2 hours of induction, cells were spun down, supernatant was discarded, and the cells were resuspended in M9 minimal media containing 0.5% glucose. Culture supernatant was then analyzed at indicated time points to assess levels of butyrate production. As shown in FIG. 11B, replacement of pbt and buk with tesB leads to greater levels of butyrate production.

Example 8

Construction of Vectors for Overproducing Butyrate (FNR Driven)

The three butyrate cassettes described in Example 1 (see, e.g., Table 36, SEQ ID NO: 163, SEQ ID NO: 164, SEQ ID NO: 165) are placed under the control of a FNR regulatory region selected from (SEQ ID NO: 141 through SEQ ID NO: 157) (Table 25 and Table 26) In certain constructs, the FNR-responsive promoter is further fused to a strong ribosome binding site sequence. For efficient translation of butyrate genes, each synthetic gene in the operon was separated by a 15 base pair ribosome binding site derived from the T7 promoter/translational start site. In certain embodiments, a ydfZ promoter was used. In other embodiments, a FNRS promoter is used.

Example 9

FNR and RNS Driven In Vitro Production of Butyrate in Recombinant E. coli

Production of butyrate is assessed in E. coli Nissle strains containing the butyrate cassettes described above driven by an FNR promoter in order to determine the effect of oxygen on butyrate production. All incubations are performed at 37° C. Cultures of E. coli strains DH5a and Nissle transformed with the butyrate cassettes are grown overnight in LB and then diluted 1:200 into 4 mL of M9 minimal medium containing 0.5% glucose. The cells are grown with shaking (250 rpm) for 4-6 h and incubated aerobically or anaerobically in a Coy anaerobic chamber (supplying 90% $N_2$, 5% $CO_2$, 5% $H_2$). One mL culture aliquots are prepared in 1.5 mL capped tubes and incubated in a stationary incubator to limit culture aeration. One tube is removed at each time point (0, 1, 2, 4, and 20 hours) and analyzed for butyrate concentration by LC-MS to confirm that butyrate production in these recombinant strains can be achieved in a low-oxygen environment.

In an alternate embodiment, production of butyrate is assessed in E. coli Nissle strains containing the butyrate cassettes described above driven by an RNS promoter in order to determine the effect of nitrogen on butyrate production. Overnight bacterial cultures are diluted 1:100 into fresh LB and grown for 1.5 hrs to allow entry into early log phase. At this point, long half-life nitric oxide donor (DETA-NO; diethylenetriamine-nitric oxide adduct) is added to cultures at a final concentration of 0.3 mM to induce expression from plasmid. After 2 hours of induction, cells are spun down, supernatant is discarded, and the cells are resuspended in M9 minimal media containing 0.5% glucose. Culture supernatant is then analyzed at indicated time points to assess levels of butyrate production.

Example 10

Production of Butyrate in Recombinant E. coli

The effect of oxygen and glucose on FNR promoter driven butyrate production was compared between E. coli Nissle strains SYN501(comprises pSC101 PydfZ-ter butyrate plasmid, i.e., (ter-thiA1-hbd-crt2-pbt-buk genes under the control of a ydfZ promoter) SYN-UCD500 (comprises pSC101 PydfZ-bcd butyrate plasmid, i.e, bcd2, etfB3, etfA3, thiA1, hbd, crt2, pbt, and buk under control of the ydfZ promoter) and SYN-UCD506 (comprises pSC101 nirB-bcd butyrate plasmid, i.e., i.e, bcd2, etfB3, etfA3, thiA1, hbd, crt2, pbt, and buk under control of the nirB promoter.

Figure 14A:
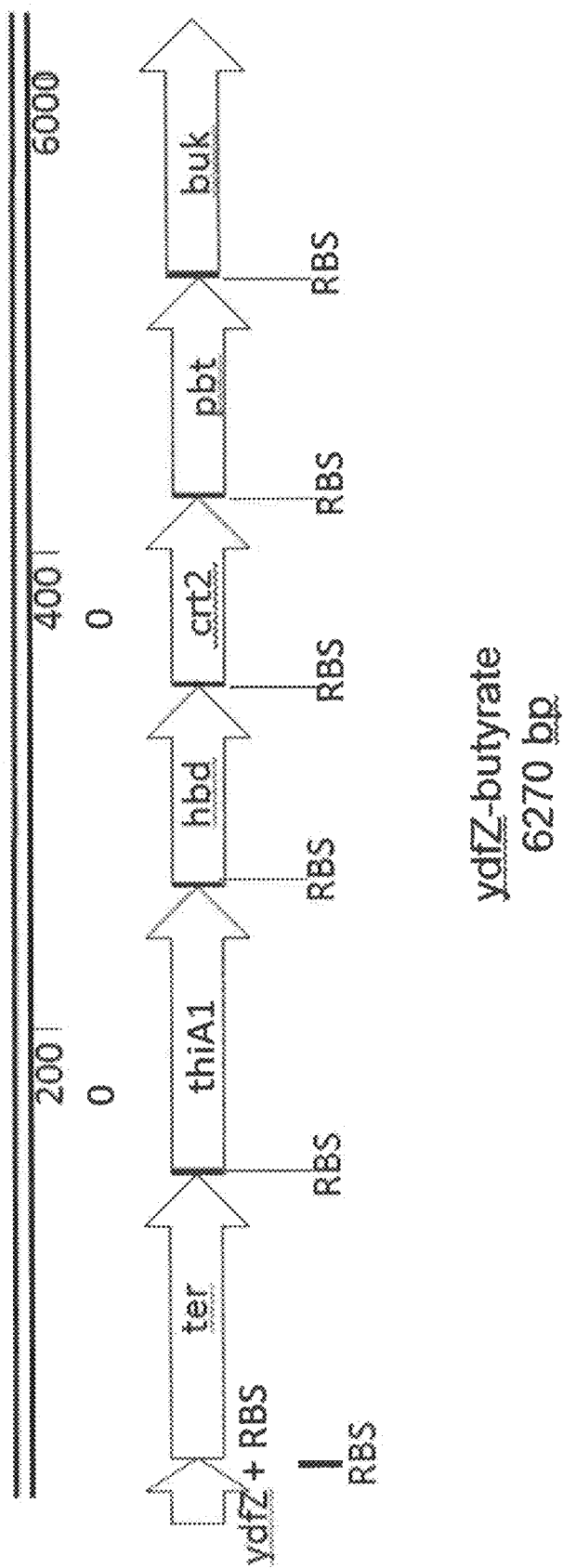
FIG. 14A, FIG. 14B, FIG. 14C, and FIG. 14D depict schematics and graphs showing butyrate or biomarker production of a butyrate producing circuit under the control of an FNR promoter.
Figure 14B:
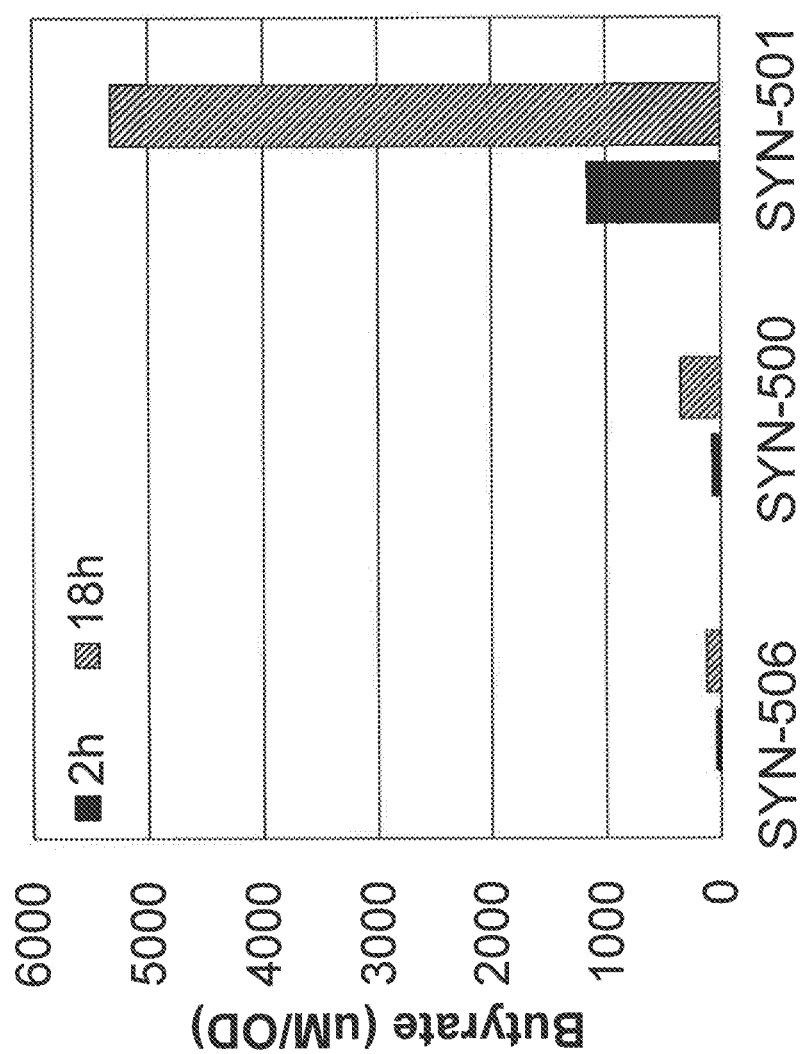

All incubations were performed at 37° C. Cultures of E. coli Nissle strains transformed with the butyrate cassettes were grown overnight in LB and then diluted 1:200 into 4 mL of M9 minimal medium containing 0.5% glucose. The cells were grown with shaking (250 rpm) for 4-6 h and incubated anaerobically in a Coy anaerobic chamber (supplying 90% $N_2$, 5% $CO_2$, 5% $H_2$) for 4 hours. Cells were washed and resuspended in minimal media w/0.5% glucose and incubated microaerobically to monitor butyrate production over time. One aliquot was removed at each time point (2, 8, and 24 hours) and analyzed for butyrate concentration by LC-MS to confirm that butyrate production in these recombinant strains can be achieved in a low-oxygen environment. As seen in FIG. 14B, SYN-501 led to significant butyrate production under anaerobic conditions.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 175, 176, 177, or 178, or a functional fragment thereof.

TABLE 47 ydfZ-butyrate cassettes

| Description | Sequence | SEQ ID NO |
|---|---|---|
| YdfZ promoter | CATTTCCTCTCATCCCATCCGGGGTGAGAGTCTTTT CCCCCGACTTATGGCTCATGCATGCATCAAAAAAG ATGTGAGCTTGATCAAAAACAAAAAATATTTCACTC GACAGGAGTATTTATATTGCGCCCGGATCCCTCTAG AAATAATTTTGTTTAACTTTAAGAAGGAGATATACAT | SEQ ID NO: 175 |
| YdfZ-bcd2-etfB3-etfA3-thiA1-hb-crt2-pbt-buk butyrate cassette | CATTTCCTCTCATCCCATCCGGGGTGAGAGTCTTTT CCCCCGACTTATGGCTCATGCATGCATCAAAAAAG ATGTGAGCTTGATCAAAAACAAAAAATATTTCACTC GACAGGAGTATTTATATTGCGCCCGGATCCCTCTAG AAATAATTTTGTTTAACTTTAAGAAGGAGATATACAT atggatttaaattctaaaaaatatcagatgcttaaagagctatatgtaagcttcgctgaaa atgaagttaaacctttagcaacagaacttgatgaagaagaaagatttccttatgaaaca gtggaaaaaatggcaaaagcaggaatgatgggtataccatatccaaaagaatatggt ggagaaggtggagacactgtaggatatataatggcagttgaagaattgtctagagttt | SEQ ID NO: 176 |

TABLE 47-continued ydfZ-butyrate cassettes

| Description | Sequence | SEQ ID NO |
|---|---|---|
| | gtggtactacaggagttatattatcagctcatacatctcttggctcatggcctatatatca<br>atatggtaatgaagaacaaaaacaaaaattcttaagaccactagcaagtggagaaaa<br>attaggagcatttggtcttactgagcctaatgctggtacagatgcgtctggccaacaaa<br>caactgctgttttagacggggatgaatacatacttaatggctcaaaaatattataacaa<br>acgcaatagctggtgacatatatgtagtaatggcaatgactgataaatctaaggggaa<br>caaaggaatatcagcatttatagttgaaaaaggaactcctgggtttagctttggagttaa<br>agaaaagaaaatgggtataagaggttcagctacgagtgaattaatatttgaggattgca<br>gaatacctaaagaaaatttacttggaaaagaaggtcaaggatttaagatagcaatgtct<br>actcttgatggtggtagaattggtatagctgcacaagctttaggtttagcacaaggtgct<br>cttgatgaaactgttaaatatgtaaaagaaagagtacaatttggtagaccattatcaaaa<br>ttccaaaatacacaattccaattagctgatatggaagttaaggtacaagcggctagaca<br>ccttgtatatcaagcagctataaataaagacttaggaaaacctttatggagtagaagcag<br>caatggcaaaattatttgcagctgaaacagctatggaagttactacaaaagctgtacaa<br>cttcatggaggatatggatacactcgtgactatccagtagaaagaatgatgagagatg<br>ctaagataactgaaatatatgaaggaactagtgaagttcaaagaatggttatttcagga<br>aaactattaaaatagtaagaaggagatatacatatggaggaaggatttatgaatatagt<br>cgtttgtataaaacaagttccagatacaacagaagttaaactagatcctaatacaggta<br>ctttaattagagatggagtaccaagtataaataaaccctgatgataaagcaggtttagaa<br>gaagctataaaattaaaagaagaaatgggtgctcatgtaactgttataacaatgggacc<br>tcctcaagcagatatggctttaaaagaagctttagcaatgggtgcagatagaggtatat<br>tattaacagatagagcatttgcgggtgctgatacttgggcaacttcatcagcattagca<br>ggagcattaaaaaatatagattttgatattataatagctggaagacaggcgatagatgg<br>agatactgcacaagttggacctcaaatagctgaacatttaaatcttccatcaataacata<br>tgctgaagaaataaaaactgaaggtgaatatgtattagtaaaaagacaatttgaagatt<br>gttgccatgacttaaaagttaaaatgccatgccttataacaactcttaaagatatgaaca<br>caccaagatacatgaaagttggaagaatatatgatgctttcgaaaatgatgtagtagaa<br>acatggactgtaaaagatatagaagttgacccttctaatttaggtcttaaaggttctccaa<br>ctagtgtatttaaatcatttacaaaatcagttaaaccagctggtacaatatacaatgaaga<br>tgcgaaaacatcagctggaattatcatagataaattaaaagagaagtatatcatataata<br>agaaggagatatacatatgggtaacgttttagtagtaatagaacaaagagaaaatgta<br>attcaaactgtttctttagaattactaggaaaggctacagaaatagcaaaagattatgat<br>acaaaagtttctgcattacttttaggtagtaaggtagaaggtttaatagatacattagcac<br>actatggtgcagatgaggtaatagtagtagatgatgaagctttagcagtgtatacaact<br>gaaccatatacaaaagcagcttatgaagcaataaaaagcagctgaccctatagttgtatt<br>atttggtgcaacttcaataggtagagatttagcgcctagagtttctgctagaatacatac<br>aggtcttactgctgactgtacaggtcttgcagtagctgaagatacaaaattattattaatg<br>acaagacctgcctttggtggaaatataatggcaacaatagtttgtaaagatttcagacct<br>caaatgtctacagttagaccaggggttatgaagaaaaatgaacctgatgaaactaaag<br>aagctgtaattaaccgtttcaaggtagaatttaatgatgctgataaattagttcaagttgta<br>caagtaataaaagaagctaaaaaacaagttaaaatagaagatgctaagatattagtttc<br>tgctggacgtggaatgggtggaaaagaaaacttagacatactttatgaattagctgaaa<br>ttataggtggagaagtttctggttctcgtgccactatagatgcaggttggttagataaag<br>caagacaagttggtcaaactggtaaaactgtaagaccagacctttatatagcatgtggt<br>atatctggagcaatacaacatatagctggtatggaagatgctgagtttatagttgctata<br>aataaaaatccagaagctccaatatttaaatatgctgatgttggtatagttggagatgttc<br>ataaagtgcttccagaacttatcagtcagttaagtgttgcaaaagaaaaaggtgaagttt<br>tagctaactaataagaaggagatatacatatgagagaagtagtaattgccagtgcagc<br>tagaacagcagtaggaagttttggaggagcatttaaatcagtttcagcggtagagttag<br>gggtaacagcagctaaagaagctataaaaagagctaacataactccagatatgatag<br>atgaatctcttttaggggagtacttacagcaggtcttggacaaaatatagcaagacaa<br>atagcattaggagcaggaataccagtagaaaaaccagctatgactataaatatagtttg<br>tggttctggattaagatctgtttcaatggcatctcaacttatagcattaggtgatgctgata<br>taatgttagttggtggagctgaaaacatgagtatgtctccttatttagtaccaagtgcga<br>gatatggtgcaagaatgggtgatgctgcttttgttgattcaatgataaaagatggattatc<br>agacatatttaataactatcacatgggtattactgctgaaaacatagcagagcaatgga<br>atataactagagaagaacaagatgaattagctcttgcaagtcaaaatagcaagaaa<br>agctcaagctgaaggaaaatttgatgaagaaatagttcctgttgttataaaaggaagaa<br>aaggtgacactgtagtagataaagatgaatatattaagcctggcactacaatggagaa<br>acttgctaagttaagacctgcatttaaaaaagatggaacagttactgctggtaatgcatc<br>aggaataaatgatggtgctgctatgttagtagtaatggctaaagaaaaagctgaagaa<br>ctaggaatagagcctcttgcaactatagtttcttatggaacagctggtgttgaccctaaa<br>ataatgggatatggaccagttccagcaactaaaaaagctttagaagctgctaatatgac<br>tattgaagatatagatttagttgaagctaatgaggcatttgctgcccaatctgtagctgta<br>ataagagacttaaatatagatatgaataaagttaatgttaatggtggagcaatagctata<br>ggacatccaataggatgctcaggagcaagaatacttactacacttttatatgaaatgaa<br>gagaagagatgctaaaactggtcttgctacacttgtataggcggtggaatgggaact<br>actttaatagttaagagatagtaagaaggagatatacatatgaaattagctgtaataggt<br>agtggaactatgggaagtggtattgtacaaacttttgcaagttgtggacatgatgtatgtt<br>taaagagtagaactcaaggtgctatagataaatgtttagctttattagataaaaatttaact<br>aagttagttactaagggaaaaattggatgaagctacaaaagcagaaattaagtcatgt<br>tagttcaactactaattatgaagatttaaaagatatggatttaataatagaagcatctgtag<br>aagacatgaatataaagaagatgttttcaagttactagatgaattatgtaaagaagata<br>ctatctcttggcaacaaatacttcatcattatctataacagaaatagcttcttctactaagcgc<br>ccagataaagtttataggaatgcatttctttaatccagttcctatgatgaaattagttgaagt<br>tataagtggtcagttaacatcaaaagttacttttgatacagtatttgaattatctaagagtat | |

TABLE 47-continued ydfZ-butyrate cassettes

| Description | Sequence | SEQ ID NO |
|---|---|---|
| | caataaagtaccagtagatgtatctgaatctcctggatttgtagtaaatagaatacttata<br>cctatgataaatgaagctgttggtatatatgcagatggtgttgcaagtaaagaagaaat<br>agatgaagctatgaaattaggagcaaaccatccaatgggaccactagcattaggtgat<br>ttaatcggattagatgttgttttagctataatgaacgttttatatactgaatttggagatacta<br>aatatagacctcatccactttttagctaaaatggttagagctaatcaattaggaagaaaaa<br>ctaagataggattctatgattataataaataataagaaggagatatacatatgagtacaa<br>gtgatgttaaagtttatgagaatgtagctgttgaagtagatggaaatatatgtacagtga<br>aaatgaatagacctaaagcccttaatgcaataaattcaaagacttttagaagaactttatg<br>aagtatttgtagatattaataatgatgaaactattgatgttgtaatattgacaggggaagg<br>aaaggcatttgtagctggagcagatattgcatacatgaaagatttagatgctgtagctg<br>ctaaagattttagtatcttaggagcaaaagcttttggagaaatagaaaatagtaaaaaa<br>gtagtgatagctgctgtaaacggatttgcttaggtggaggatgtgaacttgcaatggc<br>atgtgatataagaattgcatctgctaaagctaaatttggtcagccagaagtaactcttgg<br>aataactccaggatatggaggaactcaaaggcttacaagattggttggaatggcaaaa<br>gcaaaagaattaatctttacaggtcaagttataaaagctgatgaagctgaaaaaatagg<br>gctagtaaatagagtcgttgagccagacatttttaatagaagaagttgagaaattagcta<br>agataatagctaaaaatgctcagcttgcagttagatactctaaagaagcaatacaactt<br>ggtgctcaaactgatataaatactggaatagatatagaatctaatttatttggtctttgttttt<br>caactaaagaccaaaagaaggaatgtcagctttcgttgaaaagagagaagctaactt<br>tataaaaggtaataagaaggagatatacatatgagaagttttgaagaagtaattaagtt<br>tgcaaaagaaagaggacctaaaactatatcagtagcatgttgccaagataaagaagtt<br>ttaatggcagttgaaatggctagaaaagaaaaaatagcaaatgccattttagtaggag<br>atatagaaaagactaaagaaattgcaaaaagcatagacatggatatcgaaaattatga<br>actgatagatataaaagatttagcagaagcatctctaaaatctgttgaattagtttcacaa<br>ggaaaagccgacatggtaatgaaaggcttagtagacacatcaataataactaaaagca<br>gttttaaataaagaagtaggtcttagaactggaaatgtattaagtcacgtagcagtatttg<br>atgtagagggatatgatagattattttttcgtaactgacgcagctatgaacttagctcctga<br>tacaaatactaaaaagcaaatcatagaaaatgcttgcacagtagcacattcattagatat<br>aagtgaaccaaaagttgctgcaatatgcgcaaaagaaaaagtaaatccaaaaatgaa<br>agatacagttgaagctaaagaactagaagaaatgtatgaaagaggagaaatcaaag<br>gttgtatggttggtgggccttttgcaattgataatgcagtatcttagaagcagctaaaca<br>taaaggtataaatcatcctgtagcaggacgagctgatatattattagccccagatattga<br>aggtggtaacatattatataaagctttggtattcttctcaaaatcaaaaaatgcaggagtt<br>atagttggggctaaagcaccaataatattaacttctagagcagacagtgaagaaacta<br>aactaaactcaatagctttaggtgttttaatggcagcaaaggcataataagaaggagat<br>atacatatgagcaaaatatttaaaatcttaacaataaatcctggttcgacatcaactaaaa<br>tagctgtatttgataatgaggatttagtatttgaaaaaactttaagacattcttcagaagaa<br>ataggaaaatatgagaaggtgtctgaccaatttgaatttcgtaaacaagtaatagaaga<br>agctctaaaagaaggtggagtaaaaacatctgaattagatgctgtagtaggtagagga<br>ggacttcttaaacctataaaaggtggtacttattcagtaagtgctgctatgattgaagattt<br>aaaagtgggagttttaggagaacacgcttcaaacctaggtggaataatagcaaaaca<br>aataggtgaagaagtaaatgttccttcatacatagtagaccctgttgttgtagatgaatta<br>gaagatgttgctagaatttctggtatgcctgaaataagtagagcaagtgtagtacatgct<br>ttaaatcaaaaggcaatagcaagaagatatgctagagaaataaacaagaaatatgaa<br>gatataaatcttatagttgcacacatgggtggaggagttctgttggagctcataaaaat<br>ggtaaaatagtagatgttgcaaacgcattagatgggagaaggaccttctctccagaaa<br>gaagtggtggactaccagtaggtgcattagtaaaaatgtgctttagtggaaaatatact<br>caagatgaaattaaaagaaaataaaaggtaatggcggactagttgcatacttaaaca<br>ctaatgatgctagagaagttgaagaaagaattgaagctggtggtgataaaaagctaaatt<br>agtatatgaagctatggcatatcaaatctctaaagaaataggagctagtgctgcagttct<br>taagggagatgtaaaagcaatattattaactggtggaatcgcatattcaaaaatgtttac<br>agaaatgattgcagatagagttaaatttatagcagatgtaaaagtttatccaggtgaaga<br>tgaaatgattgcattagctcaaggtggacttagagttttaactggtgaagaagaggctc<br>aagtttatgataactaataa | |
| YdfZ-ter-<br>thiA1-hbd-<br>crt2-pbt-buk | CATTTCCTCTCATCCCATCCGGGGTGAGAGTCTTTT<br>CCCCCGACTTATGGCTCATGCATGCATCAAAAAAG<br>ATGTGAGCTTACAAAAACAAAAAATATTTCACTC<br>GACAGGAGTATTTATATTGCGCCCGGATCCCTCTAG<br>AAATAATTTTGTTTAACTTTAAGAAGGAGATATACA<br>Tatgatcgtaaaacctatggtacgcaacaatatctgcctgaacgcccatcctcagggc<br>tgcaagaagggagtggaagatcagattgaatataccaagaaacgcattaccgcaga<br>agtcaaagctggcgcaaaagctccaaaaaacgttctggtgcttggctgctcaaatggt<br>tacggcctggcgagccgcattactgctgcgttcggatacggggctgcgaccatcggc<br>gtgtcctttgaaaaagcgggttcagaaaccaaatatggtacaccgggatggtacaata<br>atttggcatttgatgaagcggcaaaacgcgagggtctttatagcgtgacgatcgacgg<br>cgatgcgttttcagacgagatcaaggcccaggtaattgaggaagccaaaaaaaag<br>gtatcaaatttgatctgatcgtatacagcttggccagcccagtacgtactgatcctgata<br>caggtatcatgcacaaaagcgttttgaaacccttggaaaaacgttcacaggcaaaac<br>agtagatccgtttactggcgagctgaaggaaatctccgcggaaccagcaaatgacga<br>ggaagcagccgccactgttaaagttatgggggtgaagattgggaacgttggattaa<br>gcagctgtcgaaggaaggcctcttagaagaaggctgtattaccttggcctatagttata<br>ttggccctgaagctacccaagctttgtaccgtaaaggcacaatcggcaaggccaaag<br>aacacctggaggccacagcacaccgtctcaacaaagagaacccgtcaatccgtgcc<br>ttcgtgagcgtgaataaaggcctggtaacccgcgcaagcgccgtaatcccggtaatc | SEQ ID<br>NO: 177 |

TABLE 47-continued ydfZ-butyrate cassettes

| Description | Sequence | SEQ ID NO |
|---|---|---|
| | cctctgtatctcgccagcttgttcaaagtaatgaaagagaagggcaatcatgaaggttg<br>tattgaacagatcacgcgtctgtacgccgagcgcctgtaccgtaaagatggtacaatt<br>ccagttgatgaggaaaatcgcattcgcattgatgattgggagttagaagaagacgtcc<br>agaaagcggtatccgcgttgatggagaaagtcacgggtgaaaacgcagaatctctca<br>ctgacttagcggggtaccgccatgatttcttagctagtaacggctttgatgtagaaggta<br>ttaattatgaagcggaagttgaacgcttcgaccgtatctgataagaaggagatatacat<br>atgagagaagtagtaattgccagtgcagctagaacagcagtaggaagttttggagga<br>gcatttaaatcagtttcagcggtagagttaggggtaacagcagctaaagaagctataa<br>aaagagctaacataactccagatatgatagatgaatctcttttaggggagtacttaca<br>gcaggtcttggacaaaatatagcaagacaaatagcattaggagcaggaataccagta<br>gaaaaaccagctatgactataaatatagtttgtggttctggattaagatctgtttcaatgg<br>catctcaacttatagcattaggtgatgctgatataatgttagttggtggagctgaaaacat<br>gagtatgtctccttatttagtaccaagtgcgagatatggtgcaagaatgggtgatgctg<br>cttttgttgattcaatgataaaagatggattatcagacatatttaataactatcacatgggt<br>attactgctgaaaacatagcagagcaatggaatataactagagaagaacaagatgaat<br>tagctcttgcaagtcaaaataaagctgaaaaagctcaagctgaaggaaaatttgatga<br>agaaatagttcctgttgttataaaaggaagaaaaggtgacactgtagtagataaagatg<br>aatatattaagcctggcactacaatggagaaacttgctaagttaagacctgcatttaaaa<br>agatggaacagttactgctggtaatgcatcaggaataaatgatggtgctgctatgtta<br>gtagtaatggctaaagaaaaagctgaagaactaggaatagagcctcttgcaactatag<br>tttcttatggaacagctggtgttgaccctaaaataatgggatatggaccagttccagcaa<br>ctaaaaaagctttagaagctgctaatatgactattgaagatatagatttagttgaagctaa<br>tgaggcatttgctgcccaatctgtagctgtaataagagacttaaatatagatatgaataa<br>agttaatgttaatggtggagcaatagctataggacatccaataggatgctcaggagca<br>agaatacttactacacttttatatgaaatgaagagaagagatgctaaaactggtcttgct<br>acactttgtataggcggtggaatgggaactactttaatagttaagagatagtaagaagg<br>agatatacatatgaaattagctgtaataggtagtggaactatgggaagtggtattgtaca<br>aacttttgcaagttgtggacatgatgtatgtttaaagagtagaactcaaggtgctatagat<br>aaatgtttagctttattagataaaaatttaactaagttagttacttaagggaaaaatggatg<br>aagctacaaaagcagaaattattaagtcatgttagttcaactactaattatgaagatttaaa<br>agatatggatttaataatagaagcatctgtagaagacatgaatataaagaaagatgtttt<br>caagttactagatgaattatgtaaagaagatactatcttggcaacaaatacttcatcatta<br>tctataacagaaatagcttcttcttctactaagcgcccagataaagttataggaatgcatttct<br>ttaatccagttcctatgatgaaattagttgaagttataagtggtcagttaacatcaaaagtt<br>actttttgatacagtatttgaattatctaagagtatcaataaagtaccagtagatgtatctga<br>atctcctggatttgtagtaaatagaatacttatacctatgataaatgaagctgttggtatat<br>atgcagatggtgttgcaagtaaagaagaaatagatgaagctatgaaattaggagcaa<br>accatccaatgggaccactagcattaggtgatttaatcggattagatgttgttttagctat<br>aatgaacgttttatatactgaatttggagatactaaatatagacctcatccacttttagcta<br>aaatggttagagctaatcaattaggaagaaaaactaagataggattctatgattataata<br>ataatagaaggagatacatatgagtacaagtgatgttaaagtttatgagaatgtag<br>ctgttgaagtagatggaaatatatgtacagtgaaaatgaatagacctaaagcccttaat<br>gcaatataattcaaagactttagaagaactttatgaagtatttgtagatattaataatgatga<br>aactattgatgttgtaatattgacaggggaaggaaaggcatttgtagctggagcagata<br>ttgcatacatgaaagatttagatgctgtagctgctaaagattttagtatcttaggagcaaa<br>agcttttggagaaatagaaaatagtaaaaaagtagtgatagctgctgtaaacggatttg<br>ctttaggtggaggatgtgaacttgcaatggcatgtgatataagaattgcatctgctaaag<br>ctaaatttggtcagccagaagtaactcttggaataactccaggatatgaggaactcaa<br>aggcttacaagattggttggaatggcaaaagcaaaagaattaatctcttacaggtcaagt<br>tataaaagctgatgaagctgaaaaaatagggctagtaaatagagtcgttgagccagac<br>atttaatagaagaagttgagaaattagctaagataatagctaaaaatgctcagcttgca<br>gttagatactctaaagaagcaatacaacttggtgctcaaactgatataaatactggaata<br>gatatagaatctaatttatttggtctttgtttttcaactaaagaccaaaaagaaggaatgtc<br>agctttcgttgaaaagagagaagctaactttataaaagggtaataagaaggagatata<br>catatgagaagtttttgaagaagtaattaagtttgcaaaagaaagaggacctaaaactat<br>atcagtagcatgttgccaagataaagaagtttaatggcagttgaaatggctagaaaag<br>aaaaaatagcaaatgccattttagtaggagatatagaaaagactaaagaaattgcaaa<br>aagcatagacatggatatcgaaaatttgaactgatagatataaagatttagcagaag<br>catctctaaaatctgttgaattagtttcacaaggaaaagccgacatggtaatgaaaggc<br>ttagtagacacatcaataatactaaaagcagttttaaattaaagaagtaggtcttagaact<br>ggaaatgtattaagtcacgtagcagtatttgatgtagagggatatgatagattattttcgt<br>aactgacgcagctatgaacttagctcctgatacaaatactaaaaagcaaatcatagaa<br>aatgcttgcacagtagcacattcattagatataagtgaaccaaaagttgctgcaatatgc<br>gcaaaagaaaagtaaatccaaaaatgaaagatacagttgaagctaaagaactagaa<br>gaaatgtatgaaagaggagaaatcaaaggttgtatggttggtgggccttttgcaattga<br>taatgcagtatctttagaagcagctaaacataaaggtataaatcatcctgtagcaggac<br>gagctgatatattattagccccagatattgaaggtggtaacatattatataaagctttggt<br>attcttctcaaaatcaaaaaatgcaggagttatagttgggggctaaagcaccaataatatt<br>aacttctagagcagacagtgaagaaactaaactaaactcaatagctttaggtgttttaat<br>ggcagcaaaggcataataagaaggagatatacatatgagcaaaatatttaaaatctta<br>acaataaatcctggttcgacatcaactaaaatagctgtatttgataatgaggatttagtatt<br>tgaaaaaacttttaagacattcttcagaagaaataggaaaatatgagaaggtgtctgacc<br>aatttgaatttcgtaaacaagtaatagaagaagctcaaaagaaggtggagtaaaaac<br>atctgaattagatgctgtagtaggtagaggaggacttcttaaacctataaaaggtggta<br>cttattcagtaagtgctgctatgattgaagatttaaaagtgggagttttaggagaacacg |  |

TABLE 47-continued ydfZ-butyrate cassettes

| Description | Sequence | SEQ ID NO |
|---|---|---|
| | cttcaaacctaggtggaataatagcaaaacaaataggtgaagaagtaaatgttccttca<br>tacatagtagaccctgttgttgtagatgaattagaagatgttgctagaatttctggtatgc<br>ctgaaataagtagagcaagtgtagtacatgctttaaatcaaaaggcaatagcaagaag<br>atatgctagagaaataaacaagaaatatgaagatataaatcttatagttgcacacatgg<br>gtggaggagtttctgttggagctcataaaaatggtaaaatagtagatgttgcaaacgca<br>ttagatggagaaggaccttctctccagaaagaagtggtggactaccagtaggtgcat<br>tagtaaaaatgtgctttagtggaaaatatactcaagatgaaattaaaaagaaaataaaa<br>ggtaatggcggactagttgcatacttaaacactaatgatgctagagaagttgaagaaa<br>gaattgaagctggtgatgaaaaagctaaattagtatatgaagctatggcatatcaaatct<br>ctaaagaaataggagctagtgctgcagttcttaagggagatgtaaaagcaatattatta<br>actggtggaatcgcatattcaaaaatgtttacagaaatgattgcagatagagttaaattta<br>tagcagatgtaaaagtttatccaggtgaagatgaaatgattgcattagctcaaggtgga<br>cttagagtttttaactggtgaagaagaggctcaagtttatgataactaataa | |
| Ydfz-ter-<br>thiA1-hbd-<br>crt2-tesb<br>butyrate<br>cassette | CATTTCCTCTCATCCCATCCGGGGTGAGAGTCTTTT<br>CCCCCGACTTATGGCTCATGCATGCATCAAAAAAG<br>ATGTGAGCTTGATCAAAAACAAAAAATATTTCACTC<br>GACAGGAGTATTTATATTGCGCCCGGATCCCTCTAG<br>AAATAATTTTGTTTAACTTTAAGAAGGAGATATACAT<br>atgatcgtaaaacctatggtacgcaacaatatctgcctgaacgcccatcctcagggct<br>gcaagaagggagtggaagatcagattgaatataccaagaaacgcattaccgcagaa<br>gtcaaagctggcgcaaaagctccaaaaaacgttctggtgcttggctgctcaaatggtt<br>acggcctggcgagccgcattactgctgcgttcggatacggggctgcgaccatcggc<br>gtgtcctttgaaaaagcgggttcagaaaccaaatatggtacaccgggatggtacaata<br>atttggcatttgatgaagcggcaaaacgcgagggtctttatagcgtgacgatcgacgg<br>cgatgcgttttcagacgagatcaaggcccaggtaattgaggaagccaaaaaaaaag<br>gtatcaaatttgatctgatcgtatacagcttggccagcccagtacgtactgatcctgata<br>caggtatcatgcacaaaagcgttttgaaaccccttggaaaaacgttcacaggcaaaac<br>agtagatccgtttactggcgagctgaaggaaatctccgcgaaccagcaaatgacga<br>ggaagcagccgccactgttaaagttatgggggtgaagattgggaacgttggattaa<br>gcagctgtcgaaggaaggcctcttagaagaaggctgtattaccttggcctatagttata<br>ttggccctgaagctacccaagctttgtaccgtaaaggcacaatcggcaaggccaaag<br>aacacctggaggccacagcacaccgtctcaacaaagagaacccgtcaatccgtgcc<br>ttcgtgagcgtgaataaaggcctggtaacccgcgcaagcgccgtaatcccggtaatc<br>cctctgtatctcgccagcttgttcaaagtaatgaaagagaagggcaatcatgaaggttg<br>tattgaacagatcacgcgtctgtacgccgagcgcctgtaccgtaaagatggtacaatt<br>ccagttgatgaggaaaatcgcattcgcattgatgattgggagttagaagaagacgtcc<br>agaaagcggtatccgcgttgatggagaaagtcacggggtgaaaacgcagaatctctca<br>ctgacttagcggggtaccgccatgatttcttagctagtaacggctttgatgtagaaggta<br>ttaattatgaagcggaagttgaacgcttcgaccgtatctgataagaaggagatatacat<br>atgagagaagtagtaattgccagtgcagctagaacagcagtaggaagttttggagga<br>gcatttaaatcagtttcagcggtagagttaggggtaacagcagctaaagaagctataa<br>aaagagctaacataactccagatatgatagatgaatctcttttaggggggagtacttaca<br>gcaggtcttggacaaaatatagcaagacaaatagcattaggagcaggaatccagta<br>gaaaaaccagctatgactataaatatagtttgtggttctggattaagatctgtttcaatgg<br>catctcaacttatagcattaggtgatgctgatataatgttagttggtggagctgaaaacat<br>gagtatgtctccttatttagtaccaagtgcgagatatggtgcaagaatgggtgatgctg<br>cttttgttgattcaatgataaaagatggattatcagacatatttaataactatcacatgggt<br>attactgctgaaaacatagcagagcaatggaatataactagagaagaacaagatgat<br>tagctcttgcaagtcaaaataaagctgaaaaagctcaagctgaaggaaaatttgatga<br>agaaatagttcctgttgttataaaaggaagaaaaggtgacactgtagtagataaagatg<br>aatatattaagcctggcactacaatggagaaacttgctaagttaagacctgcatttaaaa<br>aagatggaacagttactgctggtaatgcatcaggaataaatgatggtgctgctatgtta<br>gtagtaatggctaaagaaaaagctgaagaactaggaataagagcctcttgcaactatag<br>tttcttatggaacagctggtgttgacccccaaaataatgggatatggaccagttccagcaa<br>ctaaaaaagctttagaagctgctaatatgactattgaagatatagatttagttgaagctaa<br>tgaggcatttgctgcccaatctgtagctgtaataagagacttaaatatagatatgaataa<br>agttaatgttaatggtggagcaatagctataggacatccaataggatgctcaggagca<br>agaatacttactacacttttatatgaaatgaagagaagagatgctaaaactggtcttgct<br>acactttgtataggcggtggaatgggaactacttttaatagttaagagatagtaagaagg<br>agatatacatgaaattagctgtaataggtagtggaactatgggaagtggtattgtaca<br>aacttttgcaagttgtgacatgatgtatgtttaaagagtagaactcaaggtgctatagat<br>aaatgtttagctttattagataaaaatttaactaagttagttactaagggaaaaatggatg<br>aagctacaaaagcagaaatattaagtcatgttagttcaactactaattatgaagatttaaa<br>agatatggatttaataatagaagcatctgtagaagacatgaatataaagaaagatgtttt<br>caagttactagatgaatttatgtaaagaagtactatcttggcaacaaatacttcatcatta<br>tctataacagaaatagcttcttctactaagcgcccagataaagtttataggaatgcatttct<br>ttaatccagttcctatgatgaaattagttgaagttataagtggtcagttaacatcaaaagtt<br>acttttgatacagtatttgaattatctaagagtatcaataaagtaccagtagatgtatctga<br>atctcctggatttgtagtaaatagaatacttatacctatgataaatgaagctgttggtatat<br>atgcagatggtgttgcaagtaaagaagaaatagatgaagctatgaaattaggagcaa<br>accatccaatgggaccactagcattaggtgatttaatcggattagatgttgtttagctat<br>aatgaacgttttatatactgaatttggagatactaaatatagacctcatccactttttagcta<br>aaatggttagagctaatcaattaggaagaaaaactaagataggattctatgattataata<br>ataataagaaggagatatacatatgagtacaagtgatgttaaagtttatgagaatgtag | SEQ ID<br>NO: 178 |

TABLE 47-continued ydfZ-butyrate cassettes

| Description | Sequence | SEQ ID NO |
|---|---|---|
| | ctgttgaagtagatggaaatatatgtacagtgaaaatgaatagacctaaagcccttaat<br>gcaataaattcaaagactttagaagaactttatgaagtatttgtagatattaataatgatga<br>aactattgatgttgtaatattgacaggggaaggaaaggcatttgtagctggagcagata<br>ttgcatacatgaaagatttagatgctgtagctgctaaagattttagtatcttaggagcaaa<br>agcttttggagaaatagaaaatagtaaaaaagtagtgatagctgctgtaaacggatttg<br>ctttaggtggaggatgtgaacttgcaatggcatgtgatataagaattgcatctgctaaag<br>ctaaatttggtcagccagaagtaactcttggaataactccaggatatggaggaactcaa<br>aggcttacaagattggttggaatggcaaaagcaaaagaattaatctttacaggtcaagt<br>tataaaagctgatgaagctgaaaaaatagggctagtaaatagagtcgttgagccagac<br>attttaatagaagaagttgagaaattagctaagataatagctaaaaatgctcagcttgca<br>gttagatactctaaagaagcaatacaacttggtgctcaaactgatataaatactggaata<br>gatatagaatctaatttatttggtctttgtttttcaactaaagaccaaaaagaaggaatgtc<br>agctttcgttgaaaagagagaagctaactttataaaagggtaataagaaggagatata<br>catatgAGTCAGGCGCTAAAAAATTTACTGACATTGTT<br>AAATCTGGAAAAAATTGAGGAAGGACTCTTTCGCG<br>GCCAGAGTGAAGATTTAGGTTTACGCCAGGTGTTTG<br>GCGGCCAGGTCGTGGGTCAGGCCTTGTATGCTGCA<br>AAAGAGACCGTCCCTGAAGAGCGGCTGGTACATTC<br>GTTTCACAGCTACTTTCTTCGCCCTGGCGATAGTAA<br>GAAGCCGATTATTTATGATGTCGAAACGCTGCGTGA<br>CGGTAACAGCTTCAGCGCCCGCCGGGTTGCTGCTAT<br>TCAAAACGGCAAACCGATTTTTTATATGACTGCCTC<br>TTTCCAGGCACCAGAAGCGGGTTTCGAACATCAAA<br>AAACAATGCCGTCCGCGCCAGCGCCTGATGGCCTC<br>CCTTCGGAAACGCAAATCGCCCAATCGCTGGCGCA<br>CCTGCTGCCGCCAGTGCTGAAAGATAAATTCATCTG<br>CGATCGTCCGCTGGAAGTCCGTCCGGTGGAGTTTCA<br>TAACCCACTGAAAGGTCACGTCGCAGAACCACATC<br>GTCAGGTGTGGATCCGCGCAAATGGTAGCGTGCCG<br>GATGACCTGCGCGTTCATCAGTATCTGCTCGGTTAC<br>GCTTCTGATCTTAACTTCCTGCCGGTAGCTCTACAG<br>CCGCACGGCATCGGTTTTCTCGAACCGGGGATTCAG<br>ATTGCCACCATTGACCATTCCATGTGGTTCCATCGC<br>CCGTTTAATTTGAATGAATGGCTGCTGTATAGCGTG<br>GAGAGCACCTCGGCGTCCAGCGCACGTGGCTTTGT<br>GCGCGGTGAGTTTTATACCCAAGACGGCGTACTGGT<br>TGCCTCGACCGTTCAGGAAGGGGTGATGCGTAATC<br>ACAATtaa | |

Example 11

Production of Butyrate in Recombinant E. coli

The effect of oxygen and glucose on butyrate production was assessed in E. coli Nissle strains using a butyrate cassette driven by a FNR promoter (ter-thiA1-hbd-crt2-pbt-buk genes under the control of a ydfZ promoter).

All incubations were performed at 37° C. Cultures of E. coli strains DH5a and Nissle transformed with the butyrate cassettes were grown overnight in LB and then diluted 1:200 into 4 mL of LB containing no glucose or RCM medium containing 0.5% glucose. The cells were grown with shaking (250 rpm) for 4-6 h and incubated aerobically or anaerobically in a Coy anaerobic chamber (supplying 90% $N_2$, 5% $CO_2$, 5% $H_2$). One mL culture aliquots were prepared in 1.5 mL capped tubes and incubated in a stationary incubator to limit culture aeration. One tube was removed at each time point (0, 1, 2, 4, and 20 hours) and analyzed for butyrate concentration by LC-MS to confirm that butyrate production in these recombinant strains can be achieved in a low-oxygen environment.

Figure 14C:
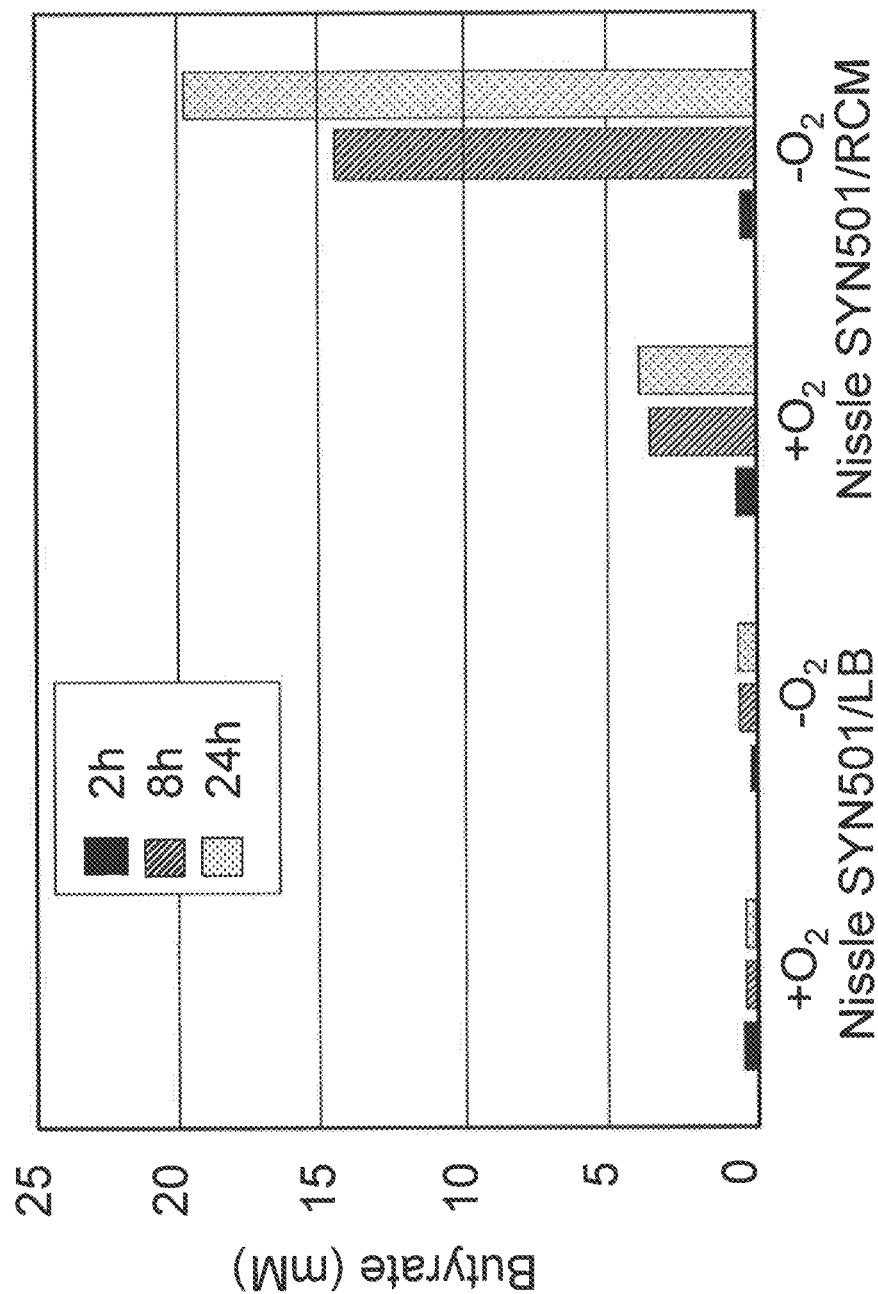

FIG. 14C depicts butyrate production in strains comprising an FNR-butyrate cassette (having the ter substitution) in the presence/absence of glucose and oxygen and shows that bacteria need both glucose and anaerobic conditions for butyrate production from the FNR promoter. Cells were grown aerobically or anaerobically in media containing no glucose (LB) or in media containing glucose at 0.5% (RMC). Culture samples were taken at indicated time pints and supernatant fractions were assessed for butyrate concentration using LC-MS. These data show that SYN501 requires glucose for butyrate production and that in the presence of glucose butyrate production can be enhanced under anaerobic conditions when under the control of the anaerobic FNR-regulated ydfZ promoter.

Example 12

Optimization of a Low-Dose DSS-Induced Colitis Model for the Detection of Compromised Barrier Function To Determine the optimal DDS concentration to administer to mice to be able to investigate compromised barrier function, as study was conducted in mice using various concentrations of DSS.

Briefly, C57BL6 mice (12 weeks, N=25) were treated with 0.25%, 0.5%, 1% and 1.5% DSS and FITC-dextran (4 kD).

On day 0 of the study, animals were weighed, and randomized mice into 5 treatment groups (n=5/group) according to weight as follows: Group 1-H2O Control, n=5; Group 2-0.25% DSS n=5; Group 3-0.5% DSS, n=5; Group 4-1% DSS, n=5; Group 5-1.5% DSS, n=5. Fecal pellets were collected and water was changed to DSS-containing water.

Animals were again weighed on day one and three. On day two, blood samples were collected for spectrophotometric analysis of FITC. On day four, mice were fasted for 4 h and gavaged all mice with 0.6 mg/g FITC-dextran (4 kD). At 3 h post FITC-dex administration, animals were weighed and bled. Fecal pellets were collected and colon samples were harvested. Blood samples were processed for spectrophotometric analysis of FITC, and serum was prepared from whole blood.

Figure 15:
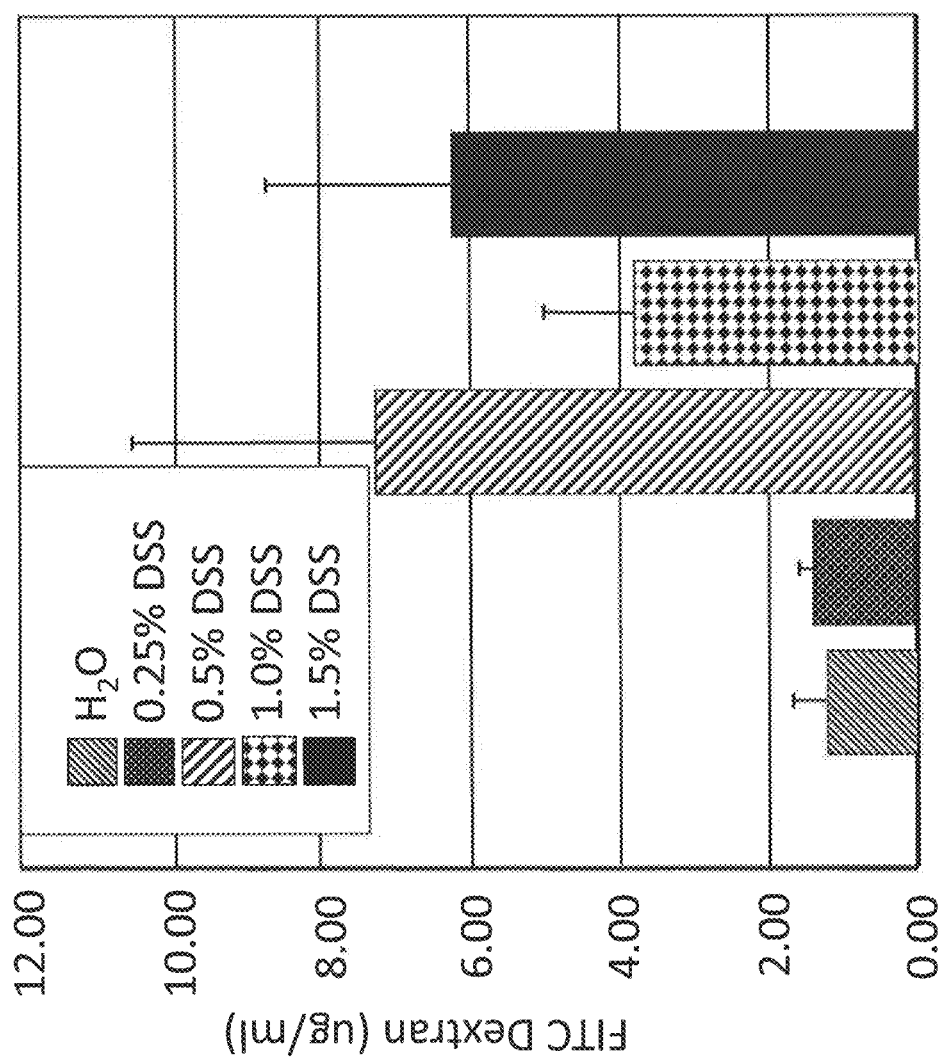
FIG. 15 depicts a graph measuring gut-barrier function in dextran sodium sulfate (DSS)-induced mouse models of IBD. The amount of FITC dextran found in the plasma of mice administered different concentrations of DSS was measured as an indicator of gut barrier function.
Figure 16:
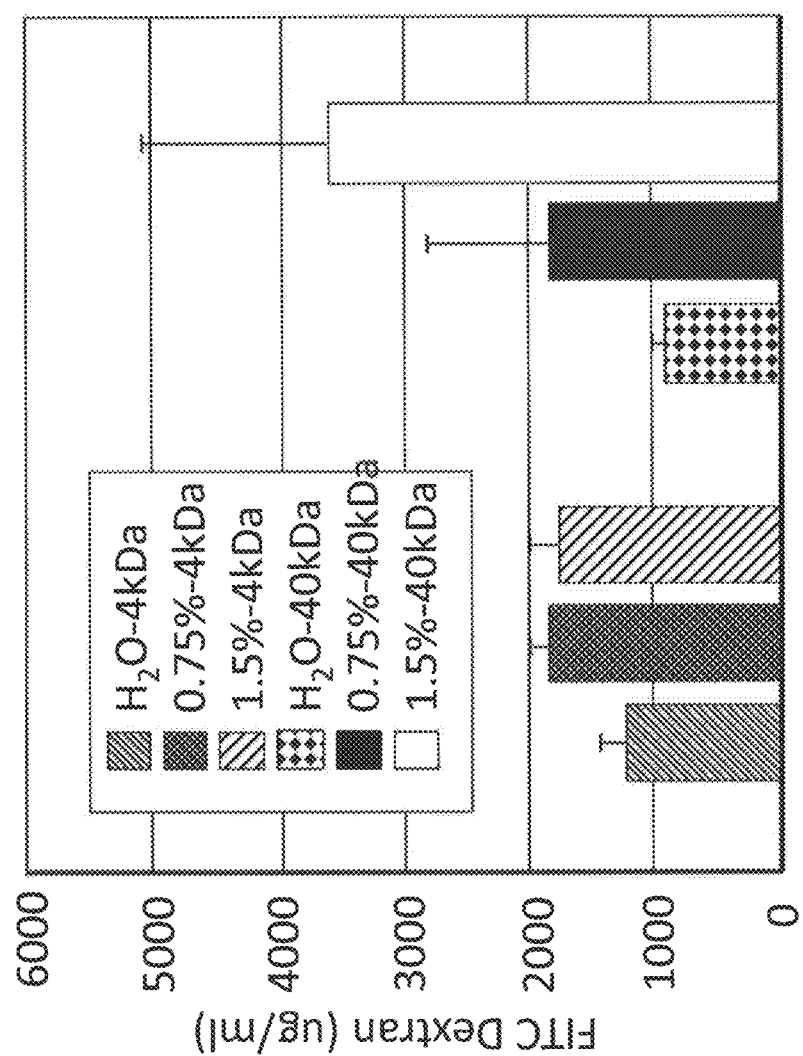
FIG. 16 depicts serum levels of FITC-dextran analyzed by spectrophotometry. FITC-dextran is a readout for gut barrier function in the DSS-induced mouse model of IBD.
Figure 17:
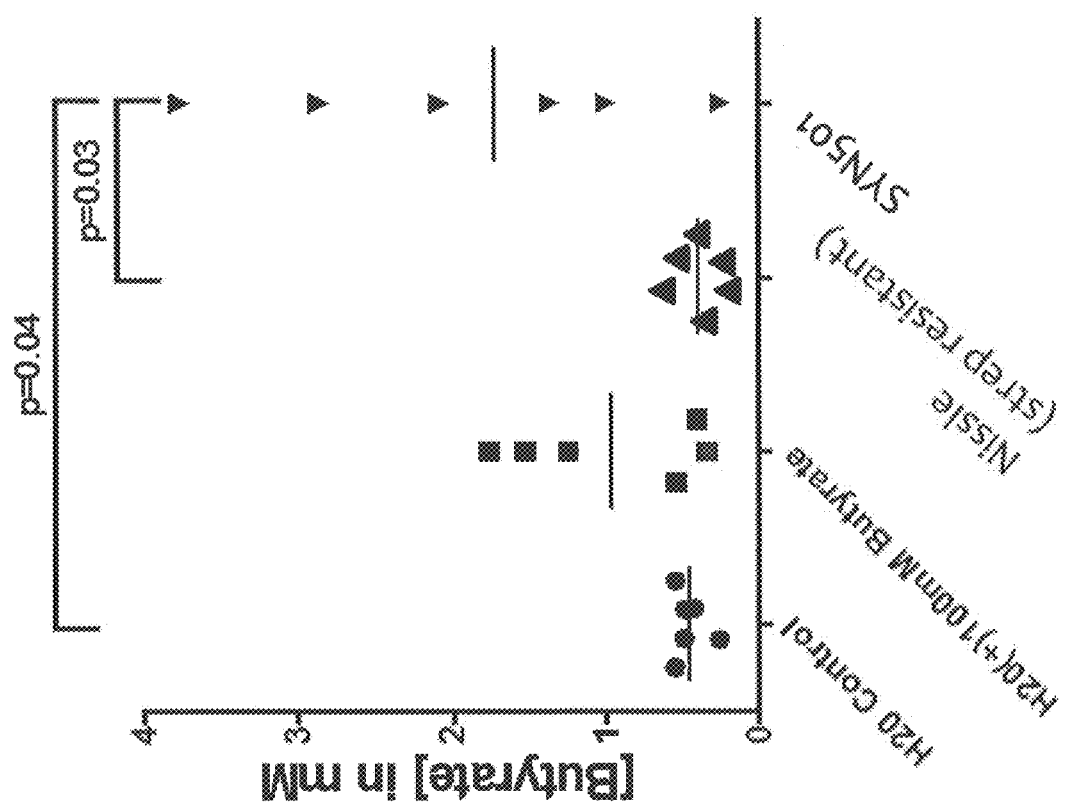
FIG. 17 depicts a scatter graph of butyrate concentrations in the feces of mice gavaged with either H2O, 100 mM butyrate in H20, streptomycin resistant Nissle control or SYN501 comprising a PydfZ-ter→pbt-buk butyrate plasmid. Significantly greater levels of butyrate were detected in the feces of the mice gavaged with SYN501 as compared mice gavaged with the Nissle control or those given water only. Levels are close to 2 mM and higher than the levels seen in the mice fed with $H_2O$ (+) 200 mM butyrate.
Figure 25:
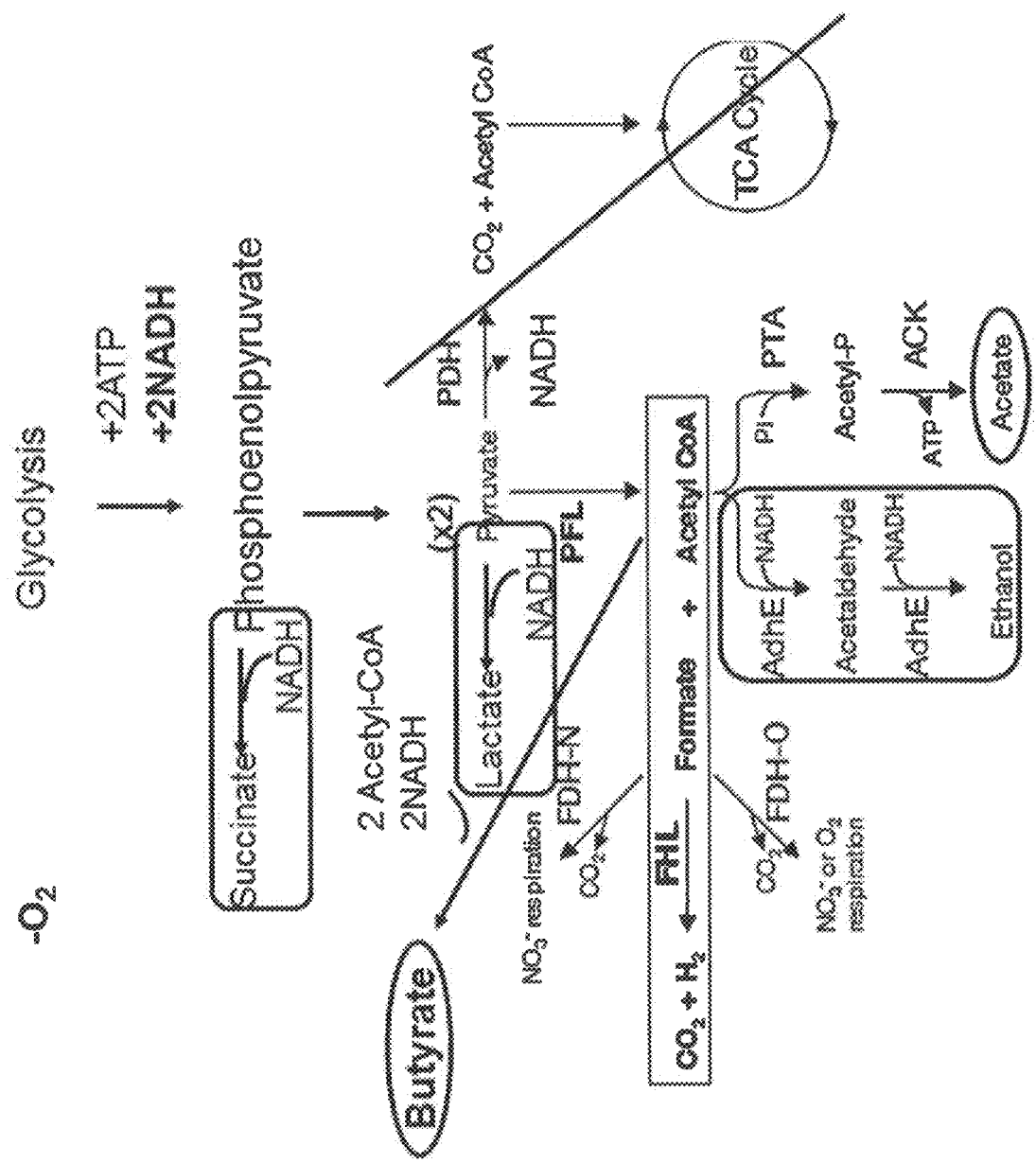
FIG. 25 depicts a schematic illustrating a strategy for increasing butyrate and acetate production in engineered bacteria. Aerobic metabolism through the citric acid cycle (TCA cycle) (crossed out) is inactive in the anaerobic environment of the colon. E. coli makes high levels of acetate as an end production of fermentation. To improve acetate production, while still maintaining highlevels of butyrate production, targeted deletion can be introduced to prevent the production of unnecessary metabolic fermentative byproducts (thereby simultaneously increasing butyrate and acetate production). Non-limiting examples of competing routes (shown in in rounded boxes) are frdA (converts phosphoenolpyruvate to succinate), ldhA (converts pyruvate to lactate) and adhE (converts Acetyl-CoA to Ethanol). Deletions of interest therefore include deletion of adhE, ldh, and frd. Thus, in certain embodiments, the genetically engineered bacteria further comprise mutations and/or deletions in one or more of frdA, ldhA, and adhE.

Fecal pellets are analyzed for levels of mouse lipocalin2 and calprotectin by ELISA (RnD systems), as seen in FIG. 25. CRP levels are also analyzed by ELISA (R&D Systems). Colon tissue is analyzed for increased levels of IL-la/b, -6, -13, -18, CCL1, CXCL1, TNFa, IFNg EpCAM, MPO and G-CSF by qPCR. Serum was analyzed for FITC-dextran levels by spectrophotometry, and results are shown in FIG. 15. As seen in FIG. 15, 0.5% DSS is the lowest dose at which an increase in FITC dextran was observed.

Example 13

Comparison of Low-Dose DSS Concentrations and Different FITC MW for the Detection of Compromised Barrier Function A study was conducted to determine the optimal DSS concentration (0.75 or 1.5%) and molecular weight FITC-Dextran (4 or 40 kDA) to administer to mice to be able to investigate compromised barrier function.

C57BL6 (9 weeks, n=18), were treated with DSS as follows DSS-0.75 and 1.5%; FITC-dextran (4 and 40 kD) and effects on molecular markers of colitis (as assessed by Spectrophotometry and ELISA) assessed, and body weight and overall animal health were monitored.

On day 0, mice were weighed and randomized mice into 3 treatment groups (n=6/group) according to weight as follows: Group 1-H2O Control, n=6; Group 2-0.75% DSS, n=6; Group 3-1.5% DSS, n=6. Water was changed to DSS-containing water.

Mice were again weighed on days 1-3. ON day 4, mice were fasted for 4 hours, and 3 mice from each group were gavaged with 0.6 mg/g of either 4 kDa or 40 kDa FITC-dextran. Mice 1-3 and 4-6 (as designated by tail marks) from each group were used for 4 kDa and 40 kDa FITC-dex administration respectively. At 3 h post FITC-dex administration, mice were weighed and bled, and fecal pellets were collected. Blood samples were processed for spectrophotometric analysis of FITC, and serum from whole blood was prepared.

Analysis of serum for FITC-dextran levels by spectrophotometry is shown in FIG. 15.

Example 14

Butyrate-Producing Bacterial Strain Reduces Gut Inflammation in a Low-Dose DSS-Induced Mouse Model of IBD At Day 0, 40 C57BL6 mice (8 weeks of age) were weighed and randomized into the following five treatment groups (n=8 per group): $H_2O$ control (group 1); 0.5% DSS control (group 2); 0.5% DSS+100 mM butyrate (group 3); 0.5% DSS+SYN94 (group 4); and 0.5% DSS+SYN363 (group 5). After randomization, the cage water for group 3 was changed to water supplemented with butyrate (100 mM), and groups 4 and 5 were administered 100 μL, of SYN94 and SYN363 by oral gavage, respectively. At Day 1, groups 4 and 5 were gavaged with bacteria in the morning, weighed, and gavaged again in the evening. Groups 4 and 5 were also gavaged once per day for Day 2 and Day 3.

At Day 4, groups 4 and 5 were gavaged with bacteria, and then all mice were weighed. Cage water was changed to either $H_2O$+0.5% DSS (groups 2, 4, and 5), or $H_2O$+0.5% DSS supplemented with 100 mM butyrate (group 3). Mice from groups 4 and 5 were gavaged again in the evening. On Days 5-7, groups 4 and 5 were gavaged with bacteria in the morning, weighed, and gavaged again in the evening.

At Day 8, all mice were fasted for 4 hours, and groups 4 and 5 were gavaged with bacteria immediately following the removal of food. All mice were then weighed, and gavaged with a single dose of FITC-dextran tracer (4 kDa, 0.6 mg/g body weight). Fecal pellets were collected; however, if colitis was severe enough to prevent feces collection, feces were harvested after euthanization. All mice were euthanized at exactly 3 hours following FITC-dextran administration. Animals were then cardiac bled and blood samples were processed to obtain serum. Levels of mouse lipocalin 2, calprotectin, and CRP-1 were quantified by ELISA, and serum levels of FITC-dextran were analyzed by spectrophotometry (see also Example 8).

Figure 14D:
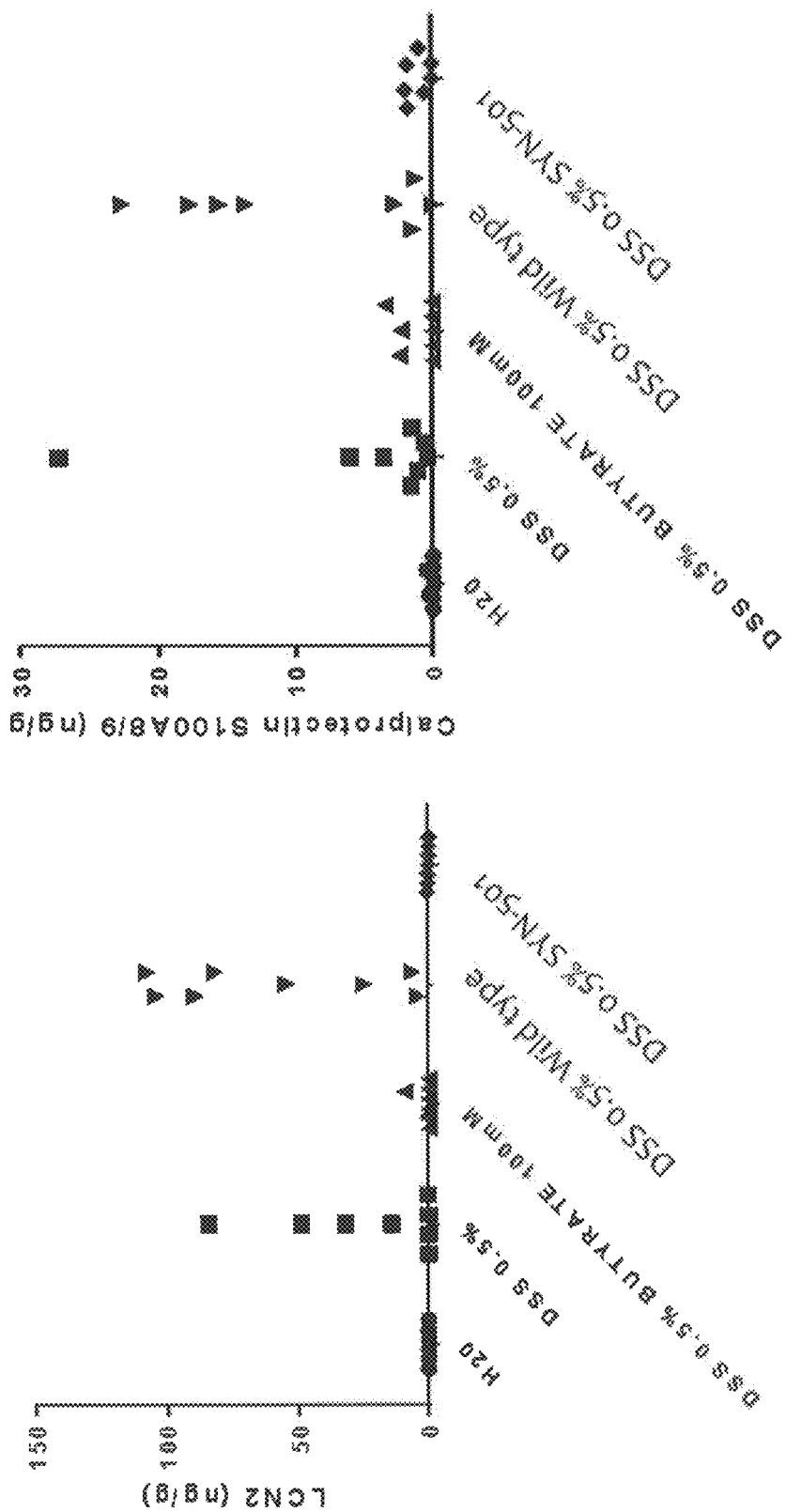

FIG. 14D shows lipocalin 2 (LCN2) levels in all treatment groups, as demonstrated by ELISA, on Day 8 of the study. Since LCN2 is a biomarker of inflammatory disease activity, these data suggest that SYN-501 produces enough butyrate to significantly reduce LCN2 concentrations, as well as gut inflammation, in a low-dose DSS-induced mouse model of IBD.

Example 15

Comparison of In Vitro Butyrate Production Efficacy of Chromosomal Insertion and Plasmid-Bearing Engineered Bacterial Strains The in vitro butyrate production efficacy of engineered bacterial strains harboring a chromosomal insertion of a butyrate cassette was compared to a strain bearing a butyrate cassette on a plasmid. SYN1001 and SYN1002 harbor a chromosomal insertion between the agaI/rsml locus of a butyrate cassette (either ter→tesB or ter→pbt-buk, respectively) driven by an fnr inducible promoter. These strains were compared side by side with the low copy plasmid strain SYN501 (Logic156 (pSC101 PydfZ-ter→pbt-buk butyrate plasmid) also driven by an fnr inducible promoter. Butyrate levels in the media were measured at 4 and 24 hours post anaerobic induction.

Figure 29:
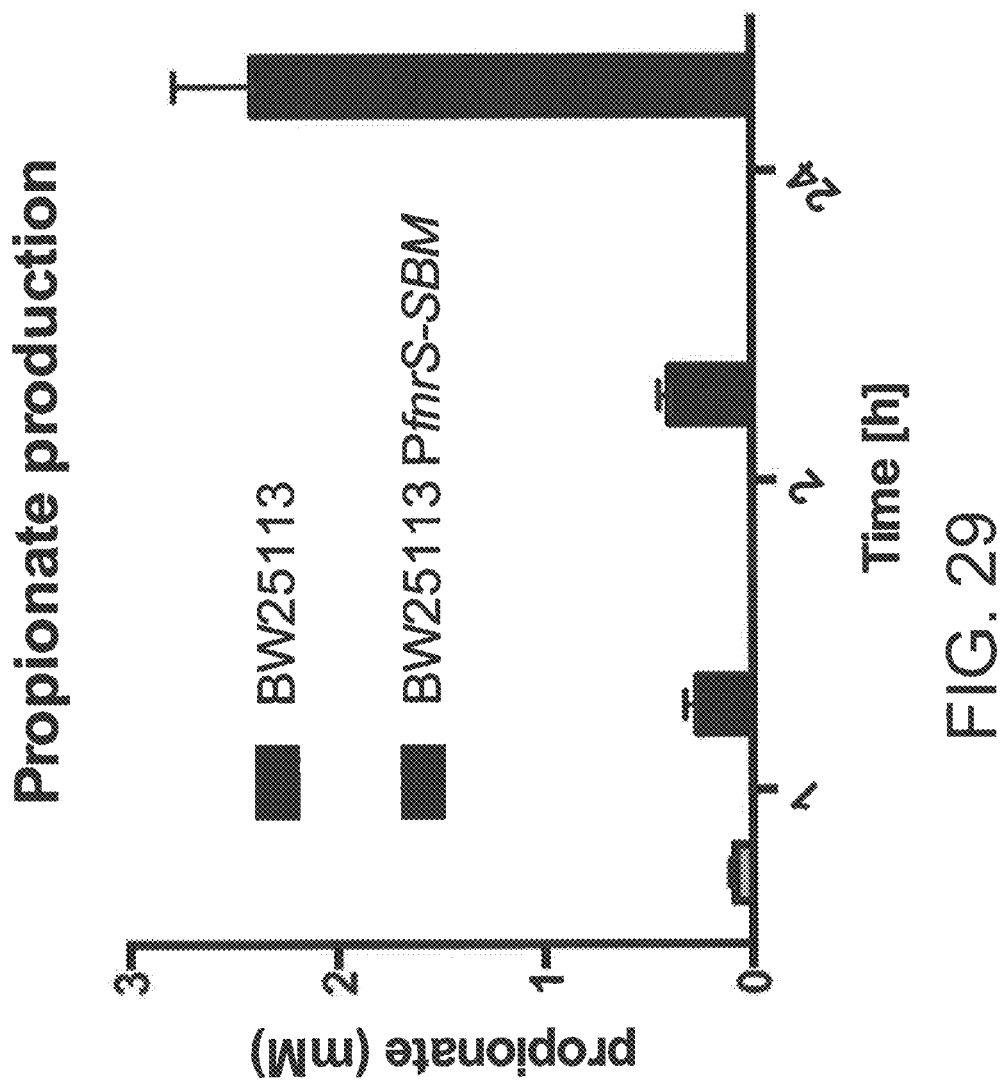
FIG. 29 depicts a bar graph of proprionate concentrations produced in vitro by the wild type E coli BW25113 strain and a BW25113 strain which comprises the endogenous SBM operon under the control of the FnrS promoter, as depicted in the schematic in FIG. 28.

Briefly, 3 ml LB was inoculated with bacteria from frozen glycerol stocks. Bacteria were grown overnight at 37 C with shaking. Overnight cultures were diluted 1:100 dilution into 10 ml LB (containing antibiotics) in a 125 ml baffled flask. Cultures were grown aerobically at 37 C with shaking for about 1.5 h, and then transferred to the anaerobic chamber at 37 C for 4 h. Bacteria ($2 \times 10^8$ CFU) were added to 1 ml M9 media containing 50 mM MOPS with 0.5% glucose in microcentrifuge tubes. Cells were plated to determine cell counts. The assay tubes were placed in the anaerobic chamber at 37 C. At indicated times (4 and 24 h), 120 ul cells were removed and pelleted at 14,000 rpm for 1 min, and 100 ul of the supernatant was transferred to a 96-well assay plate and sealed with aluminum foil, and stored at −80 C until analysis by LC-MS for butyrate concentrations (as described in Example 22). Results are depicted in FIG. 29, and show that SYN1001 and SYN1002 give comparable butyrate production to the plasmid strain SYN501.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 179, 180, 181, or 182, or a functional fragment thereof.

TABLE 48

FRNRs Butyrate Cassette Sequences

| Description | Sequence |
|---|---|
| Pfnrs-ter-thiA1-hbd-ctr2-tesB SEQ ID NO: 179, e.g. integrated into the chromosome in SYN1001 Pfnrs: uppercase; butyrate cassette: lower case | GGTACCAGTTGTTCTTATTGGTGGTGTTGCTTTATGGTT GCATCGTAGTAAATGGTTGTAACAAAAGCAATTTTTCC GGCTGTCTGTATACAAAAACGCCGCAAAGTTTGAGCGA AGTCAATAAACTCTCTACCCATTCAGGGCAATATCTCTC TTGGATCCAAAGTGAACTCTAGAAATAATTTTGTTTAAC TTTAAGAAGGAGATATACATatgatcgtaaaacctatggtacgcaacaat atctgcctgaacgcccatcctcagggctgcaagaagggagtggaagatcagattgaatata ccaagaaacgcattaccgcagaagtcaaagctggcgcaaaagctccaaaaaacgttctggt gcttggctgctcaaatggttacggcctggcgagccgcattactgctgcgttcggatacgggg ctgcgaccatcggcgtgtcctttgaaaaagcgggttcagaaaccaaatatggtacaccggg atggtacaataatttggcatttgatgaagcggcaaaacgcgagggtctttatagcgtgacgat cgacggcgatgcgttttcagacgagatcaaggcccaggtaattgaggaagccaaaaaaaa aggtatcaaatttgatctgatcgtatacagcttggccagcccagtacgtactgatcctgataca ggtatcatgcacaaaagcgttttgaaaccctttggaaaaacgttcacaggcaaaacagtagat ccgttactggcgagctgaaggaaatctccgcggaaccagcaaatgacgaggaagcagcc gccactgttaaagttatgggggggtgaagattgggaacgttggattaagcagctgtcgaagga aggcctcttagaagaaggctgtattaccttggcctatagttatattggccctgaagctacccaa gctttgtaccgtaaaggcacaatcggcaaggccaaagaacacctggaggccacagcacac cgtctcaacaaagagaacccgtcaatccgtgccttcgtgagcgtgaataaaggcctggtaac ccgcgcaagcgccgtaatcccggtaatccctctgtatctcgccagcttgttcaaagtaatgaa agagaagggcaatcatgaaggttgtattgaacagatcacgcgtctgtacgccagcgcctgt accgtaaagatggtacaattccagttgatgaggaaaatcgcattcgcattgatgattgggagtt agaagaagacgtccagaaagcggtatccgcgttgatggagaagtcacgggtgaaaacgc agaatctctcactgacttagcggggtaccgccatgatttcttagctagtaacggctttgatgtag aaggtattaattatgaagcggaagttgaacgcttcgaccgtatctgataagaaggagatatac atatgagagaagtagtaattgccagtgcagctagaacagcagtaggaagttttggaggagc attttaaatcagttttcagcggtagagttaggggtaacagcagctaaagaagctataaaaagag ctaacataactccagatatgatagatgaatctcttttaggggggagtacttacagcaggtcttgg acaaaatatagcaagacaaatagcattaggagcaggaataccagtagaaaaaccagctatg actataaatatagtttgtggttctggattaagatctgtttcaatggcatctcaacttatagcattag gtgatgctgataataatgttagttggtggagctgaaaacatgagtatgtctccttatttagtaccaa gtgcgagatatggtgcaagaatgggtgatgctgcttttgttgattcaatgataaaagatggatt atcagacatatttaataactatcacatgggtattactgctgaaaacatagcagagcaatggaat ataactagagaagaacaagatgaattagctcttgcaagtcaaaataaagctgaaaaagctca agctgaaggaaaatttgatgaagaaatagttcctgttgttataaaaggaagaaaaggtgacac tgtagtagataaagatgaatatattaagcctggcactacaatggagaaacttgctaagttaaga cctgcatttaaaaaagatggaacagttactgctggtaatgcatcaggaataaatgatggtgct gctatgttagtagtaatggctaaagaaaagctgaagaactaggaatagagcctcttgcaact atagtttcttatggaacagctggtgttgaccctaaaataatgggatatggaccagttccagcaa ctaaaaaagctttagaagctgctaatatgactattgaagatatagatttagttgaagctaatgag gcatttgctgcccaatctgtagctgtaataagagacttaaatatagatatgaataaagttaatgtt aatggtggagcaatagctataggacatccaataggatgctcaggagcaagaatacttactac acttttatatgaaatgaagagaagagatgctaaaactggtcttgctacactttgtataggcggtg gaatgggaactacttttaatagttaagagatagtaagaaggagatatacatatgaaattagctgt aataggtagtggaactatgggaagtggtattgtacaaactttttgcaagttgtggacatgatgtat gtttaaagagtagaactcaaggtgctatagataaatgtttagctttattagataaaaatttaacta agttagttactaagggaaaatggatgaagctacaaaagcagaaatattaagtcatgttagttc aactactaattatgaagatttaaaagatatggatttaataataataaagcatctgtagaagacatga atataaagaaagatgttttcaagttactagatgaattatgtaaagaagatactatcttggcaaca aatacttcatcattatctataacagaaatagcttcttctactaagcgcccagataaagttatagga atgcatttctttaatccagttcctatgatgaaattagttgaagttataagtggtcagttaacatcaa aagttactttttgatacagtatttgaattatctaagagtcaataaaagttaccagtagatgtatctga atctcctggatttgtagtaaatagaatacttataccctatgataaatgaagctgttggtatatatgca gatggtgttgcaagtaaagaagaaatagatgaagctatgaaattaggagcaaaccatccaat gggaccactagcattaggtgatttaatcggattagatgttgtttttagctataatgaacgttttatat actgaattggagatactaaatatagacctcatccttttagctactaagaaaatggtagagctaatca attaggaagaaaactaagataggattctatgattataataaataataagaaggagatatacat atgagtacaagtgatgtttaaagtttatgagaatgtagctgttgaagtagatggaaatatatgtac agtgaaaatgaatagacctaaagccttaatgcaataaattcaaagactttagaagaactttat gaagtatttgtagatattaataatgatgaaactattgatgttgtaatattgacaggggaaggaaa ggcatttgtagctggagcagatattgcatacatgaaagatttagatgctgctgtgagctgctaaagat tttagtatcttaggagcaaaagcttttggagaaatagaaaatagtaaaaaagtagtgatagctg ctgtaaacggatttgcttaggtggaggatgtgaacttgcaatggcatgtgatataagaattgc atctgctaaagctaaatttggtcagccagaagtaactcttggaataactccaggatatggagg aactcaaaggcttacaagattggttggaatggcaaaagcaaaagaattaatctttacaggtca agttataaaagctgatgaagctgaaaaaatagggctagtaaatagctcgttgagccagaca ttttaatagaagaagttgagaaattagctaagataatagctaaaaatgctcagcttgcagttaga tactctaaagaagcaatacaacttggtgctcaaactgatataaatactggaatagatatagaat ctaatttatttggtctttgttttcaactaaagaccaaaaagaaggaatgtcagctttcgttgaaaa gagagaagctaactttataaaagggtaataagaaggagatatacatatgagtcaggcgctaa aaaatttactgacattgttaaatctggaaaaaaattgaggaaggactctttcgcggccagagtga

TABLE 48-continued

FRNRs Butyrate Cassette Sequences

| Description | Sequence |
|---|---|
| | agatttaggtttacgccaggtgtttggcggccaggtcgtgggtcaggccttgtatgctgcaaa<br>agagaccgtccctgaagagcggctggtacattcgtttcacagctacttcttcgccctggcga<br>tagtaagaagccgattatttatgatgtcgaaacgctgcgtgacggtaacagcttcagcgcccg<br>ccggggttgctgctattcaaaacggcaaaccgatttttatatgactgcctcttccaggcaccag<br>aagcgggtttcgaacatcaaaaaaacaatgccgtccgcgccagcgcctgatggcctcccttc<br>ggaaacgcaaatcgcccaatcgctggcgcacctgctgccgccagtgctgaaagataaattc<br>atctgcgatcgtccgctggaagtccgtccggtggagtttcataacccactgaaaggtcacgtc<br>gcagaaccacatcgtcaggtgtggatccgcgcaaatggtagcgtgccggatgacctgcgc<br>gttcatcagtatctgctcggttacgcttctgatcttaacttcctgccggtagctctacagccgca<br>cggcatcggttttctcgaaccggggattcagattgccaccattgaccattccatgtggttccat<br>cgcccgtttaatttgaatgaatggctgctgtatagcgtggagagcacctcggcgtccagcgc<br>acgtggctttgtgcgcggtgagttttatacccaagacggcgtactggttgcctcgaccgttca<br>ggaaggggtgatgcgtaatcacaattaa |
| Pfnrs-ter-thiA1-hbd-crt2-<br>pbt-buk<br>(SEQ ID NO: 180), e.g.<br>integrated into the<br>chromosome in SYN1002<br>Pfnrs: uppercase; butyrate<br>cassette: lower case | GGTACCAGTTGTTCTTATTGGTGGTGTTGCTTTATGGTT<br>GCATCGTAGTAAATGGTTGTAACAAAAGCAATTTTTCC<br>GGCTGTCTGTATACAAAAACGCCGCAAAGTTTGAGCGA<br>AGTCAATAAACTCTCTACCCATTCAGGGCAATATCTCTC<br>TTGGATCCAAAGTGAACTCTAGAAATAATTTTGTTTAAC<br>TTTAAGAAGGAGATATACATatgatcgtaaaacctatggtacgcaacaat<br>atctgcctgaacgccatcctcagggctgcaagaagggagtggaagatcagattgaatata<br>ccaagaaacgcattaccgcagaagtcaaagctggcgcaaaagctccaaaaaaacgttctggt<br>gcttggctgctcaaatggttacggcctggcgagccgcattactgctgcgttcggatacgggg<br>ctgcgaccatcggcgtgtcctttgaaaaagcgggttcagaaaccaaatatggtacaccggg<br>atggtacaataatttggcatttgatgaagcggcaaaacgcgagggtctttatagcgtgacgat<br>cgacggcgatgcgttttcagacgagatcaaggcccaggtaattgaggaagccaaaaaaaa<br>aggtatcaaatttgatctgatcgtatacagcttggccagcccagtacgtactgatcctgataca<br>ggtatcatgcacaaaagcgtttttgaaacccttggaaaaacgttcacaggcaaaacagtagat<br>ccgtttactggcgagctgaaggaaatctccgcggaaccagcaaatgacgaggaagcagcc<br>gccactgttaaagttatgggggtgaagattgggaacgttggattaagcagctgtcgaagga<br>aggcctcttagaagaaggctgtattaccttggcctatagttatattggccctgaagctacccaa<br>gctttgtaccgtaaaggcacaatcggcaaggccaaagaacacctggaggccacagcacac<br>cgtctcaacaaagagaacccgtcaatccgtgccttcgtgagcgtgaataaaggcctggtaac<br>ccgcgcaagcgccgtaatcccggtaatccctctgtatctcgccagcttgttcaaagtaatgaa<br>agagaagggcaatcatgaaggttgtattgaacagatcacgcgtctgtacgccagcgcctgt<br>accgtaaagatggtacaattccagttgatgaggaaaatcgcattcgcattgatgattgggagtt<br>agaagaagacgtccagaaagcggtatccgcgttgatggagaaagtcacgggtgaaaacgc<br>agaatctctcactgacttagcggggtaacgccatgatttcttagctagtaacggcttgatgtag<br>aaggtattaattatgaagcggaagttgaacgcttcgaccgtatctgataagaaggagatatac<br>atatgagagaagtagtaattgccagtgcagctagaacagcagtaggaagttttggaggagc<br>atttaaatcagtttcagcggtagagttaggggtaacagcagctaaagaagctataaaaagag<br>ctaacataactccagatatgatagatgaatctcttttagggggagtacttacagcaggtcttgg<br>acaaaatatagcaagacaaatagcattaggagcaggaataccagtagaaaaaccagctatg<br>actataaatatagtttgtggttctggattaagatctgtttcaatggcatctcaacttatagcattag<br>gtgatgctgatataatgttagttggtggagctgaaaacatgagtatgtctccttatttagtaccaa<br>gtgcgagatatggtgcaagaatgggtgatgctgcttttgttgattcaatgataaaagatggatt<br>atcagacatatttaataactatcacatgggtattactgctgaaaacatagcagagcaatggaat<br>ataactagagaagaacaagatgaattagctcttgcaagtcaaaataaagctgaaaaagctca<br>agctgaaggaaaatttgatgaagaaatagttcctgttgttataaaaggaagaaaaggtgacac<br>tgtagtagataaagatgaatatattaagcctggcactacaaatggagaaacttgctaagttaaga<br>cctgcatttaaaaaagatggaacagttactgctggtaatgcatcaggaatcaatgatggtgct<br>gctatgttagtagtaatggctaaagaaaaagctgaagaactaggaatagagcctcttgcaact<br>atagtttcttatggaacagctggtgttgaccctaaaataatgggatatggaccagttccagcaa<br>ctaaaaaagctttagaagctgctaatatgactattgaagatatagatttagttgaagctaatgag<br>gcatttgctgcccaatctgtagctgtaataagagacttaaatatagatatgaataagttaatgtt<br>aatggtgagcaatagctataggacatccaataggatgctcaggagcaagaatacttactac<br>acttttatatgaaatgaagagaagagatgctaaaactggtctttgctcacacttttgtataggcggtg<br>gaatgggaactactttaatagttaagagatagtaagaaggagatatacatatgaaattagctgt<br>aataggtagtggaactatgggaagtggtattgtacaaacttttgcaagttgtggacatgatgtat<br>gtttaaagagtagaactcaaggtgctatagataaatgtttagctttattagataaaaatttaacta<br>agttagttactaagggaaaatggatgaagctacaaaagcagaaatattaagtcatgttagttc<br>aactactaattatgaagatttaaaagatatggatttaataatagaagcatctgtagaagacatga<br>atataaagaaagatgttttcaagttactagatgaatttatgtaaaagaagtactatcttggcaaca<br>aatacttcatcattatctataacagaaatagcttcttctactaagcgcccagataaagttatagga<br>atgcatttctttaatccagttcctatgatgaaattagttgaagttataagtggtcagttaacatcaa<br>aagttacttttgatacagtatttgaattatctaagagtatcaataaagtaccagtagatgtatctga<br>atctcctggatttgtagtaaatagaatacttatacctatgataaatgaagctgttggtatatatgca<br>gatggtgttgcaagtaaagaagaaatagatgaagctatgaaattaggagcaaaccatccaat<br>gggaccactagcattaggtgatttaatcggattagatgttgtttagctataatgaacgttttatat<br>actgaatttggagatactaaatatagacctcatccacttttagctaaaatggttagagctaatca<br>attaggaagaaaaactaagataggattctatgattataatataaaggaggagatatacat<br>atgagtacaagtgatgttaaagtttatgagaatgtagctgttgaagtagatgaaatatatgtac<br>agtgaaaatgaatagacctaaagcccttaatgcaataaattcaaagactttagaagaactttat<br>gaagtatttgtagatattaataatgatgaaactattgatgttgtaatattgacaggggaaggaaa<br>ggcatttgtagctggagcagatattgcatacatgaaagatttagatgctgtagctgctaaagat<br>tttagtatcttaggagcaaaagcttttggagaaatagaaaatagtaaaaaagtagtgatagctg |

TABLE 48-continued

FRNRs Butyrate Cassette Sequences

| Description | Sequence |
|---|---|
| | ctgtaaacggatttgctttaggtggaggatgtgaacttgcaatggcatgtgatataagaattgc<br>atctgctaaagctaaatttggtcagccagaagtaactcttggaataactccaggatatggagg<br>aactcaaaggcttacaagattggttggaatggcaaaagcaaaagaattaatctttacaggtca<br>agttataaaagctgatgaagctgaaaaaatagggctagtaaatagagtcgttgagccagaca<br>ttttaatagaagaagttgagaaattagctaagataatagctaaaaatgctcagcttgcagttaga<br>tactctaaagaagcaatacaacttggtgctcaaactgatataaatactggaatagatatagaat<br>ctaatttatttggtctttgttttcaactaaagaccaaaaagaaggaatgtcagctttcgttgaaaa<br>gagagaagctaactttataaaagggtaataagaaggagatatacatatgagaagttttgaaga<br>agtaattaagtttgcaaaagaaagaggacctaaaactatatcagtagcatgttgccaagataa<br>agaagttttaatggcagttgaaatggctagaaaagaaaaaatagcaaatgccattttagtagg<br>agatatagaaaagactaaagaaattgcaaaaagcatagacatggatatcgaaaattatgaact<br>gatagatataaaagatttagcagaagcatctctaaaatctgttgaattagtttcacaaggaaaa<br>gccgacatggtaatgaaaggcttagtagacacatcaataatactaaaagcagttttaaataaa<br>gaagtaggtcttagaactggaaatgtattaagtcacgtagcagtatttgatgtagagggatatg<br>atagattattttcgtaactgacgcagctatgaacttagctcctgatacaaatactaaaaagcaa<br>atcatagaaaatgcttgcacagtagcacattcattagatataagtgaaccaaaagttgctgcaa<br>tatgcgcaaaagaaaaagtaaatccaaaaatgaaagatacagttgaagctaaagaactaga<br>agaaatgtatgaaagaggagaaatcaaaggttgtatggttggtgggcctttttgcaattgataat<br>gcagtatctttagaagcagctaaacataaaggtataaatcatcctgtagcaggacgagctgat<br>atattattagccccagatattgaaggtggtaacatattatataaagctttggtattcttctcaaaat<br>caaaaaatgcaggagttatagttggggctaaagcaccaataatattaacttctgagcagaca<br>gtgaagaaactaaactaaactcaatagctttaggtgttttaatggcagcaaaggcataataag<br>aaggagatatacatatgagcaaaatatttaaaatcttaacaataaatcctggttcgacatcaact<br>aaaaatagctgtatttgataatgaggatttagtatttgaaaaaactttaagacattcttcagaagaa<br>ataggaaaatatgagaaggtgtctgaccaatttgaatttcgtaaacaagtaatagaagaagct<br>ctaaaagaaggtggagtaaaaacatctgaattagatgctgtagtaggtagaggaggacttctt<br>aaacctataaaaggtggtacttattcagtaagtgctgctatgattgaagatttaaaagtgggagt<br>tttaggagaacacgcttcaaacctaggtggaataatagcaaaacaaataggtgaagaagtaa<br>atgttccttcatacatagtagaccctgttgttgtagatgaattagaagatgttgctagaatttctgg<br>tatgcctgaaataagtagagcaagtgtagtacatgctttaaatcaaaaggcaatagcaagaag<br>atatgctagagaaataaacaagaaatatgaagatataaatcttatagttgcacacatgggtgg<br>aggagtttctgttggagctcataaaaatggtaaaatagtagatgttgcaaacgcattagatgga<br>gaaggacctttctctccagaaagaagtggtggactaccagtaggtgcattagtaaaaatgtgc<br>tttagtggaaaatatactcaagatgaaattaaaaagaaaataaaaggtaatggcggactagtt<br>gcatacttaaacactaatgatgctagagaagttgaagaaagaattgaagctggtgatgaaaa<br>agctaaattagtatatgaagctatggcatatcaaatctctaaagaaataggagctagtgctgca<br>gttcttaagggagatgtaaaagcaatattattaactggtggaatcgcatattcaaaaatgtttac<br>agaaatgattgcagatagagttaaatttatagcagatgtaaaagtttatccaggtgaagatgaa<br>atgattgcattagctcaaggtggacttagagttttaactggtgaagaagaggctcaagtttatg<br>ataactaa |
| PfNRS (ribosome binding site is underlined) (SEQ ID NO: 181) | GGTACCAGTTGTTCTTATTGGTGGTGTTGCTTTATGGTT<br>GCATCGTAGTAAATGGTTGTAACAAAAGCAATTTTTCC<br>GGCTGTCTGTATACAAAAACGCCGCAAAGTTTGAGCGA<br>AGTCAATAAACTCTCTACCCATTCAGGGCAATATCTCTC<br>TTGGATCCAAAGTGAACTCTAGAAATAATTTTGTTTAAC<br>TTTAAGAAGGAGATATACAT |
| Ribosome binding site and leader region (SEQ ID NO: 182) | CTCTAGAAATAATTTTGTTTAACTTTAAGAAGGAGATAT<br>ACAT |

Example 16

Assessment of Intestinal Butyrate Levels in Response to SYN501 Administration in Mice To determine efficacy of butyrate production by the genetically engineered bacteria in vivo, the levels of butyrate upon administration of SYN501 (Logic156 (pSC101 PydfZ-ter→pbt-buk butyrate plasmid)) to C57BL6 mice was first assessed in the feces. Water containing 100 mM butyrate was used as a control.

Figure 28:
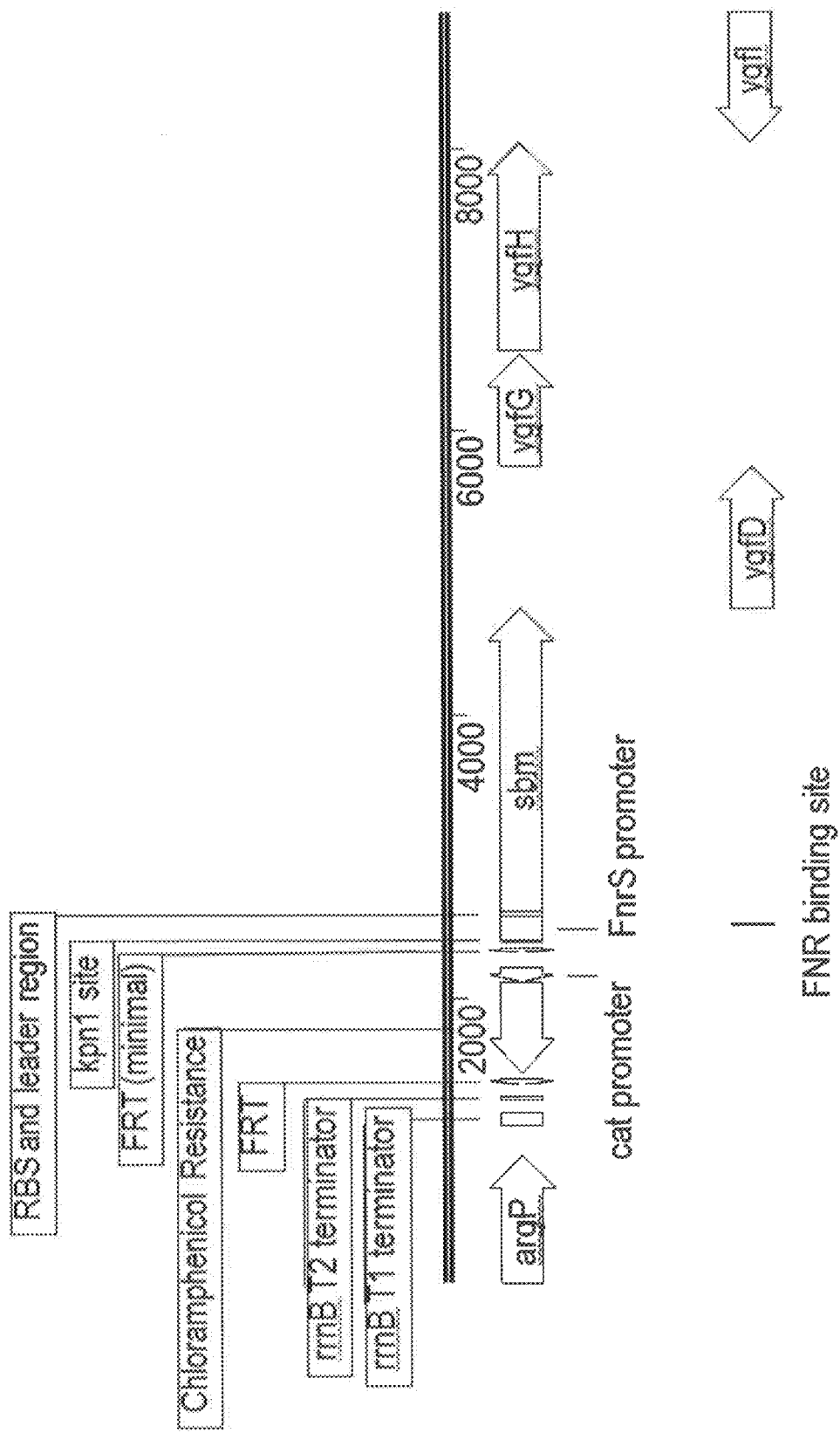
FIG. 28 depicts a schematic of a construct comprising the sleeping beauty mutase operon from E. coli under the control of a heterologous FnrS promoter.

On day 1, C57BL6 mice (24 total animals) were weighed and randomized into 4 groups; Group 1: H$_2$O control (n=6); Group 2-100 mM butyrate (n=6); Group 3-streptomycin resistant Nissle (n=6); Group 4-SYN501 (n=6). Mice were either gavaged with 100 ul streptomycin resistant Nissle or SYN501, and group 2 was changed to H20(+)100 mM butyrate at a dose of 10e10 cells/100 ul. On days 2-4, mice were weighted and Groups 3 and 4 were gavaged in the AM and the PM with streptomycin resistant Nissle or SYN501. On day 5, mice were weighed and Groups 3 and 4 were gavaged in the am with streptomycin resistant Nissle or SYN501, and feces was collected and butyrate concentrations determined as described in Example 23. Results are depicted in FIG. 28. Significantly greater levels of butyrate were detected in the feces of the mice gavaged with SYN501 as compared mice gavaged with the Nissle control or those given water only. Levels are close to 2 mM and higher than the levels seen in the mice fed with H$_2$O (+) 200 mM butyrate.

Next the effects of SYN501 on levels of butyrate in the cecum, cecal effluent, large intestine, and large intestine effluent are assessed. Because baseline concentrations of butyrate are high in these compartments, an antibiotic treatment is administered in advance to clear out the bacteria responsible for butyrate production in the intestine. As a result, smaller differences in butyrate levels can be more accurately observed and measured. Water containing 100 mM butyrate is used as a control.

During week 1 of the study, animals are treated with an antibiotic cocktail in the drinking water to reduce the baseline levels of resident microflora. The antibiotic cocktail is composed of ABX-ampicillin, vancomycin, neomycin, and metronidazole. During week 2 animals are orally administered 100 ul of streptomycin resistant Nissle or engineered strain SYN501 twice a day for five days (at a dose of 10e10 cells/100 ul).

On day 1, C57BL6 (Female, 8 weeks) are separated into four groups as follows: Group 1: $H_{20}$ control (n=10); Group 2: 100 mM butyrate (n=10); Group 3: streptomycin resistant Nissle (n=10); Group 4: SYN501 (n=10). Animals are weighed and feces is collected from the animals (T=0-time point). Animals are changed to $H_2O$ (+) antibiotic cocktail. On day 5, animals are weighed and feces is collected (time point T=5d). The $H_2O$ (+) antibiotic cocktail bottles are changed. On day 8, the mice are weighed and feces is collected. Mice of Group 3 and Group 4 are gavaged in the AM and PM with streptomycin resistant Nissle or SYN501. The water in all cages is changed to water without antibiotic. Group 2 is provided with 100 mM butyrate in H2O. On days 9-11, mice are weighed, and mice of Group 3 and Group 4 are gavaged in the AM and PM with streptomycin resistant Nissle or SYN501. On day 12, mice are gavaged with streptomycin resistant Nissle or SYN501 in the AM, and 4 hours post dose, blood is harvested, and cecal and large intestinal contents, and tissue, and feces are collected and processed for analysis.

Example 17

Comparison of Butyrate Production Levels Between the Genetically Engineered Bacteria Encoding a Butyrate Cassette and Selected *Clostridia* Strains The efficacy of pbutyrate production in SYN501 (pSC101 PydfZ-ter→pbt-buk butyrate plasmid) was compared to CBM588 (*Clostridia butyricum* MIYARISAN, a Japanese probiotic strain), *Clostridium tyrobutyricum* VPI 5392 (Type Strain), and *Clostridium butyricum* NCTC 7423 (Type Strain).

Figure 18:
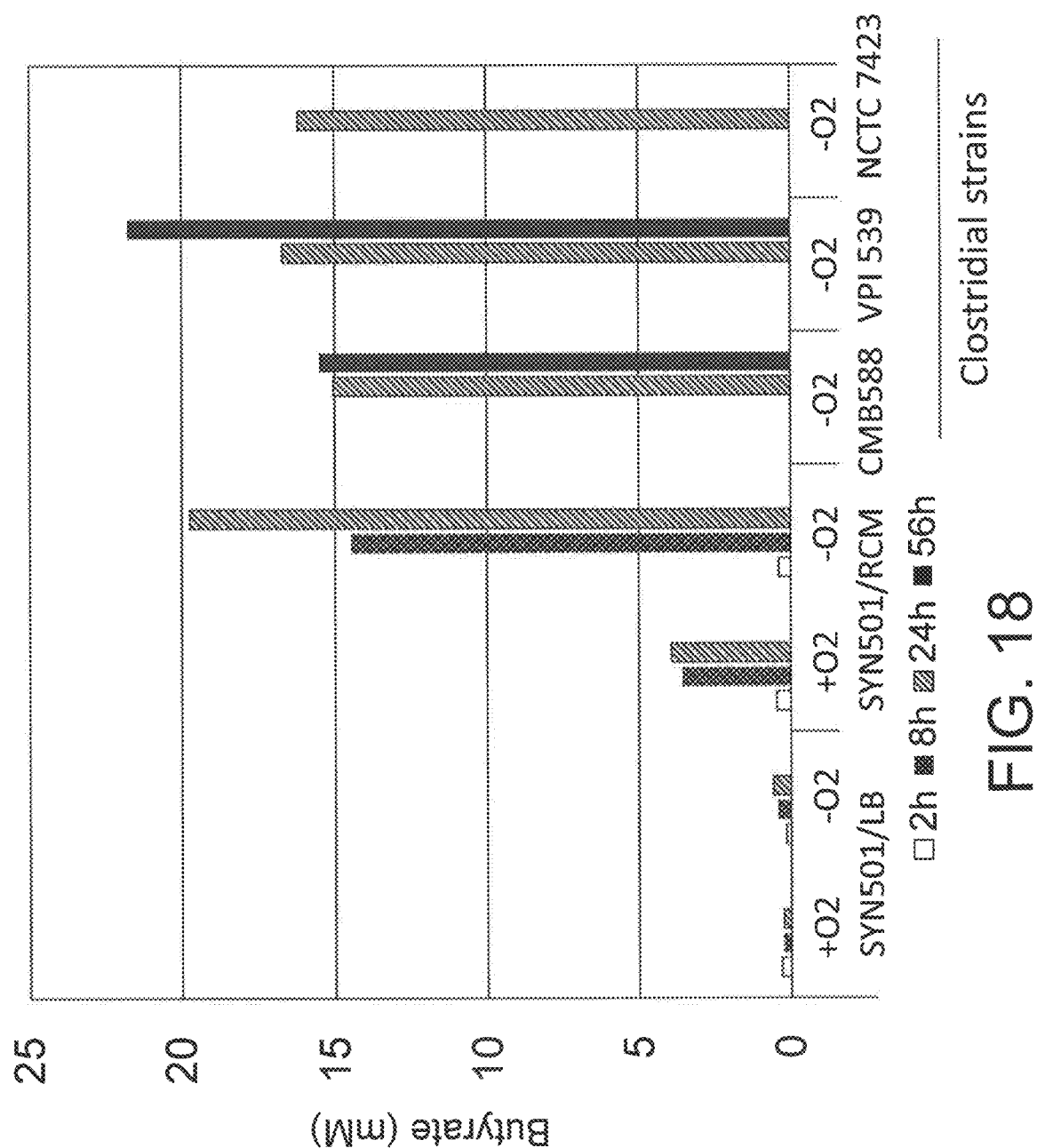
FIG. 18 depicts a bar graph comparing butyrate concentrations produced in vitro by the butyrate cassette plasmid strain SYN501 as compared to *Clostridia butyricum* MIYARISAN (a Japanese probiotic strain), *Clostridium tyrobutyricum* VPI 5392 (Type Strain), and *Clostridium butyricum* NCTC 7423 (Type Strain) under aerobic and anaerobic conditions at the indicated timepoints. The Nissle strain comprising the butyrate cassette produces butyrate levels comparable to *Clostridium* spp. in RCM media.
Figure 19:
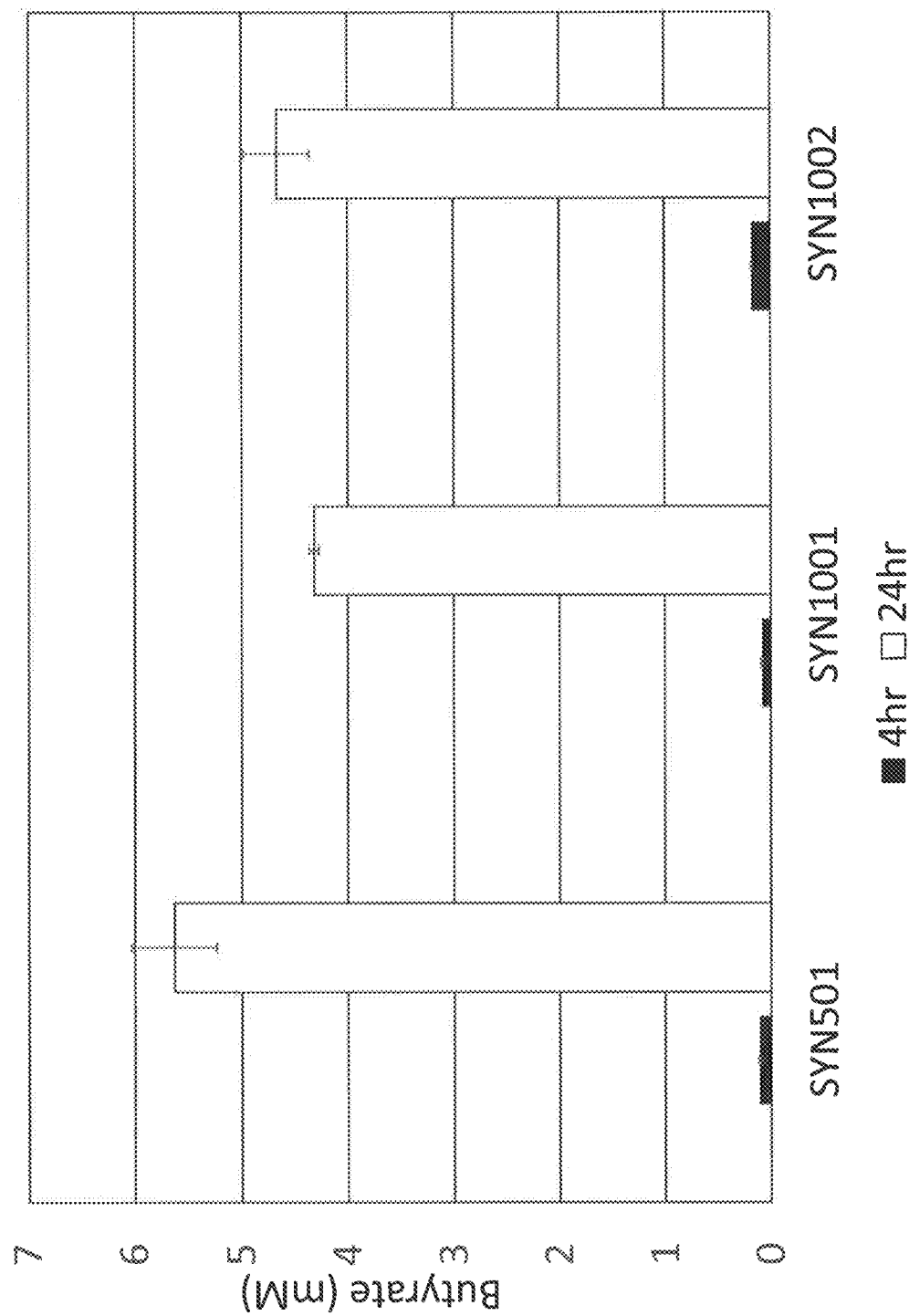
FIG. 19 depicts a bar graph showing butyrate concentrations produced in vitro by strains comprising chromsolmally integrated butyrate copies as compared to plasmid copies. Integrated butyrate strains, SYN1001 and SYN1002 (both integrated at the agaI/rsmI locus) gave comparable butyrate production to the plasmid strain SYN501.
Figure 20A:
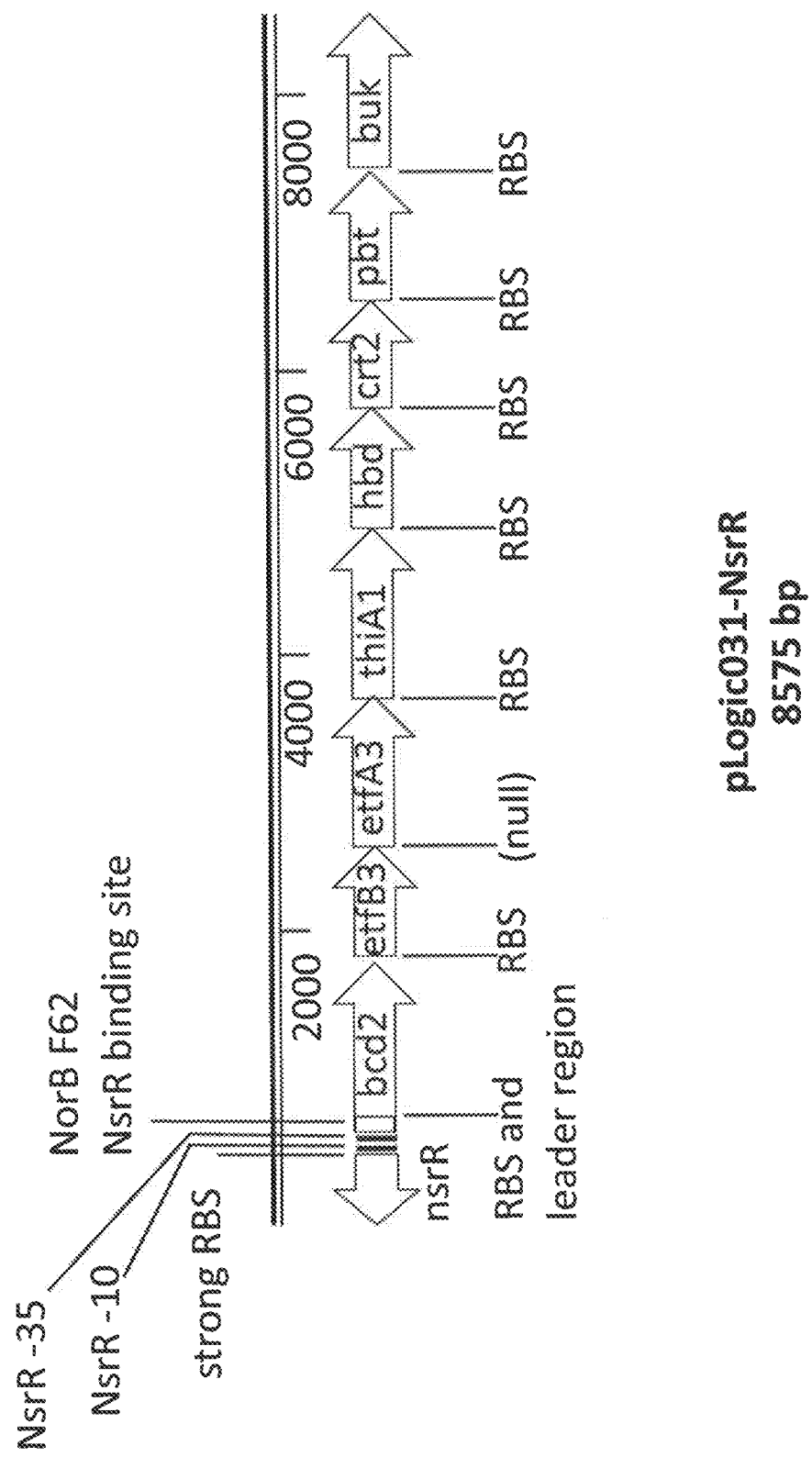
FIG. 20A and FIG. 20B depicts the construction and gene organization of an exemplary plasmids.
Figure 20B:
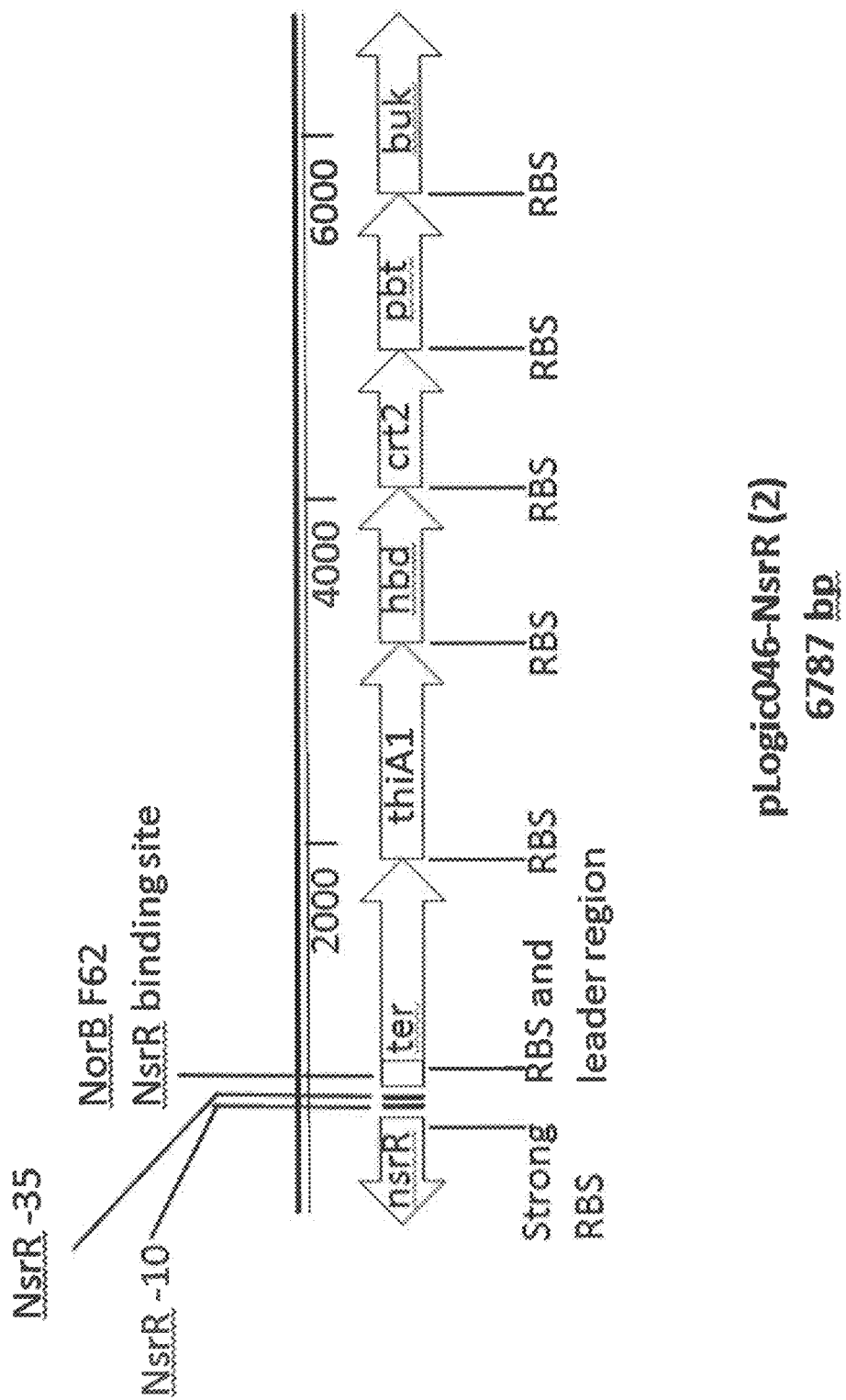

Briefly, overnight cultures of SYN501 were diluted 1:100 were grown in RCM (Reinforced Clostridial Media, which is similar to LB but contains 0.5% glucose) at 37 C with shaking for 2 hours, then either moved into the anaerobic chamber or left aerobically shaking. Clostridial strains were only grown anaerobically. At indicated times (2, 8, 24, and 48 h), 120 ul cells were removed and pelleted at 14,000 rpm for 1 min, and 100 ul of the supernatant was transferred to a 96-well assay plate and sealed with aluminum foil, and stored at −80 C until analysis by LC-MS for butyrate concentrations (as described in Example 18). Results are depicted in FIG. 18, and show that SYN501 produces butyrate levels comparable to *Clostridium* spp. in RCM media Example 18

Quantification of Butyrate by LC-MS/MS

To obtain the butyrate measurements in Example 37 a LC-MS/MS protocol for butyrate quantification was used.
Sample Preparation First, fresh 1000, 500, 250, 100, 20, 4 and 0.8 µg/mL sodium butyrate standards were prepared in water. Then, 10 µL of sample (bacterial supernatants and standards) were pipetted into a V-bottom polypropylene 96-well plate, and 90 µL of 67% ACN (60 uL ACN+30 uL water per reaction) with 4 ug/mL of butyrate-d7 (CDN isotope) internal standard in final solution were added to each sample. The plate was heat-sealed, mixed well, and centrifuged at 4000 rpm for 5 minutes. In a round-bottom 96-well polypropylene plate, 20 µL of diluted samples were added to 180 µL of a buffer containing 10 mM MES pH4.5, 20 mM EDC (N-(3-Dimethylaminopropyl)-N'-ethylcarbodiimide), and 20 mM TFEA (2,2,2-trifluroethylamine). The plate was again heat-sealed and mixed well, and samples were incubated at room temperature for 1 hour.

LC-MS/MS Method

Butyrate was measured by liquid chromatography coupled to tandem mass spectrometry (LC-MS/MS) using a Thermo TSQ Quantum Max triple quadrupole mass spectrometer. HPLC Details are listed in Table 49 and Table 50. Tandem Mass Spectrometry details are found in Table 51.

TABLE 49

| HPLC Details | |
|---|---|
| Column | Thermo Aquasil C18 column, 5 µm (50 x 2.1 mm) |
| Mobile Phase A | 100% H2O, 0.1% Formic Acid |
| Mobile Phase B | 100% ACN, 0.1% Formic Acid |
| Injection volume | 10 uL |

TABLE 50

| HPLC Method | | | |
|---|---|---|---|
| Total Time (min) | Flow Rate (µL/min) | A % | B % |
| 0 | 0.5 | 100 | 0 |
| 1 | 0.5 | 100 | 0 |
| 2 | 0.5 | 10 | 90 |
| 4 | 0.5 | 10 | 90 |
| 4.01 | 0.5 | 100 | 0 |
| 4.25 | 0.5 | 100 | 0 |

TABLE 51

| Tandem Mass Spectrometry Details | |
|---|---|
| Ion Source | HESI-II |
| Polarity | Positive |
| SRM transitions | Butyrate 170.0/71.1, Butyrate d7 177.1/78.3 |

Example 19

Quantification of Butyrate in Feces by LC-MS/MS

Sample Preparation

Fresh 1000, 500, 250, 100, 20, 4 and 0.8 µg/mL sodium butyrate standards were prepared in water. Single fecal pellets were ground in 100 uL water and centrifuged at 15,000 rpm for 5 min at 4° C. 10 μL of the sample (fecal supernatant and standards) were pipetted into a V-bottom polypropylene 96-well plate, and 90 μL of the derivatizing solution containing 50 mM of 2-Hydrazinoquinoline (2-HQ), dipyridyl disulfide, and triphenylphospine in acetonitrile with 5 ug/mL of butyrate-$d_7$ were added to each sample. The plate was heat-sealed and incubated at 60° C. for 1 hr. The plate was then centrifuged at 4,000 rpm for 5 min and 20 μL of the derivatized samples mixed to 180 μL of 22% acetonitrile with 0.1% formic acid.

LC-MS/MS Method

Butyrate was measured by liquid chromatography coupled to tandem mass spectrometry (LC-MS/MS) using a Thermo TSQ Quantum Max triple quadrupole mass spectrometer. HPLC Details are listed in Table 52 and Table 53. Tandem Mass Spectrometry details are found in Table 54.

TABLE 52

HPLC Details

| Column | Luna phenomenex C18 column, 5 μm (100 x 2.1 mm) |
|---|---|
| Mobile Phase A | 100% H2O, 0.1% Formic Acid |
| Mobile Phase B | 100% ACN, 0.1% Formic Acid |
| Injection volume | 10 uL |

TABLE 53

HPLC Method

| Total Time (min) | Flow Rate (μL/min) | A % | B % |
|---|---|---|---|
| 0 | 0.5 | 95 | 5 |
| 0.5 | 0.5 | 95 | 5 |
| 1.5 | 0.5 | 10 | 90 |
| 3.5 | 0.5 | 10 | 90 |
| 3.51 | 0.5 | 95 | 5 |
| 3.75 | 0.5 | 95 | 5 |

TABLE 54

Tandem Mass Spectrometry Details

| Ion Source | HESI-II |
|---|---|
| Polarity | Positive |
| SRM transitions | Butyrate 230.1/143.1, Butyrate d7 237.1/143.1 |

Example 20

Increasing In Vitro Butyrate and Acetate Production in Engineered Nissle

*E. coli* generates high levels of acetate as an end product of fermentation. In order to improve acetate production while also maintaining high levels butyrate production, deletions in endogenous adhE (Aldehyde-alcohol dehydrogenase) and ldh (lactate dehydrogenase) were generated to prevent or reduce metabolic flux through pathways which do not result in acetate or butyrate production (see, e.g., FIG. 25). For this study, Nissle strains with either integrated FNRS ter-tesB or FNRS-ter-pbt-buk butyrate cassettes were used. Additionally, for this study media M9 media containing 50 mM MOPS with 0.5% glucose was compared to media containing 0.5/% glucuronic acid, as glucuronic acid better mimics available carbon sources in the gut.

Briefly, bacteria were grown overnight at 37 C with shaking. Overnight cultures were diluted 1:100 into 10 ml LB (containing antibiotics) in a 125 ml baffled flask. Cultures were grown aerobically at 37 C with shaking for about 1.5 h, and then transferred to the anaerobic chamber at 37 C for 4 h. Bacteria (2×10$^8$ CFU) were added to 1 ml M9 media containing 50 mM MOPS with 0.5% glucose or 0.5% glucuronic acid in microcentrifuge tubes. Cells were plated to determine cell counts. The assay tubes were placed in the anaerobic chamber at 37 C. At 18 hours, cells were removed and pelleted at 14,000 rpm for 1 min, and 100 ul of the supernatant was transferred to a 96-well assay plate and sealed with aluminum foil, and stored at −80 C until analysis by LC-MS for butyrate and acetate concentrations as described herein in Example 18 and Example 21.

Figure 26A:
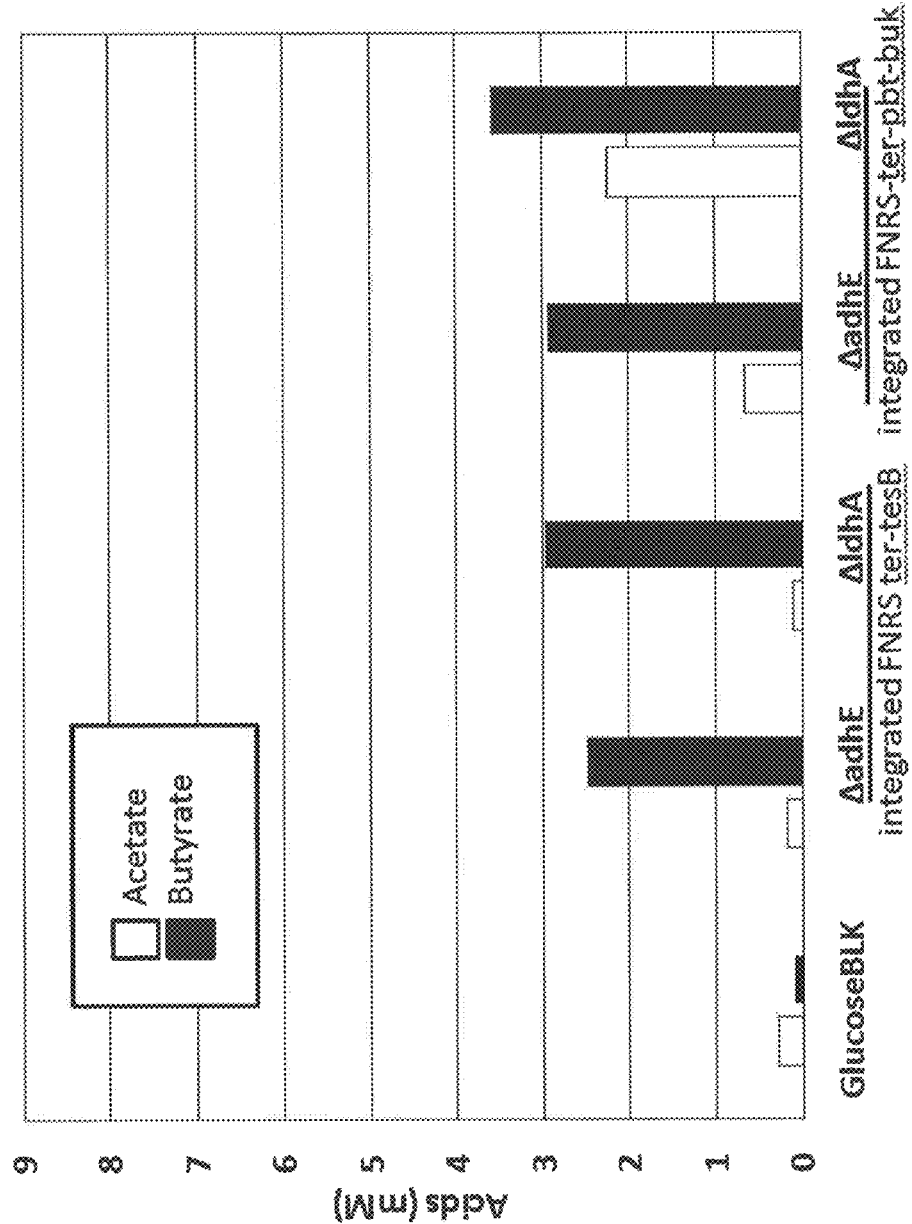
FIG. 26A and FIG. 26B depict bar graphs showing Acetate/Butyrate production in 0.5% glucose MOPS (pH6.8) (FIG. 26A) and Acetate/Butyrate production in 0.5% glucuronic acid MOPS (pH6.3) (FIG. 26B). Deletions in deletions in endogenous adhE (Aldehyde-alcohol dehydrogenase) and ldh (lactate dehydrogenase) were introduced into Nissle strains with either integrated FNRS ter-tesB or FNRS-ter-pbt-buk butyrate cassettes.
Figure 26B:
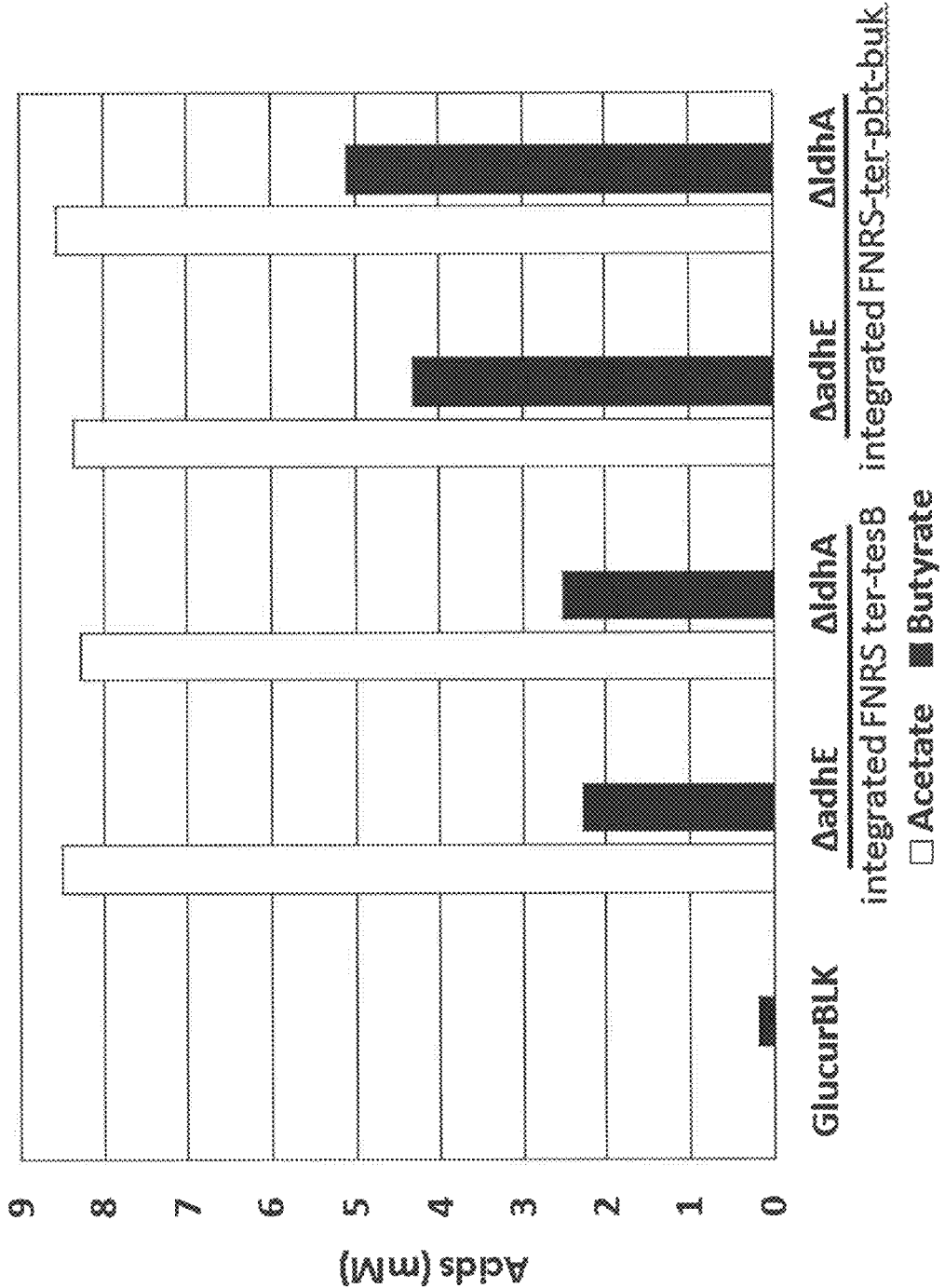
Figure 27:
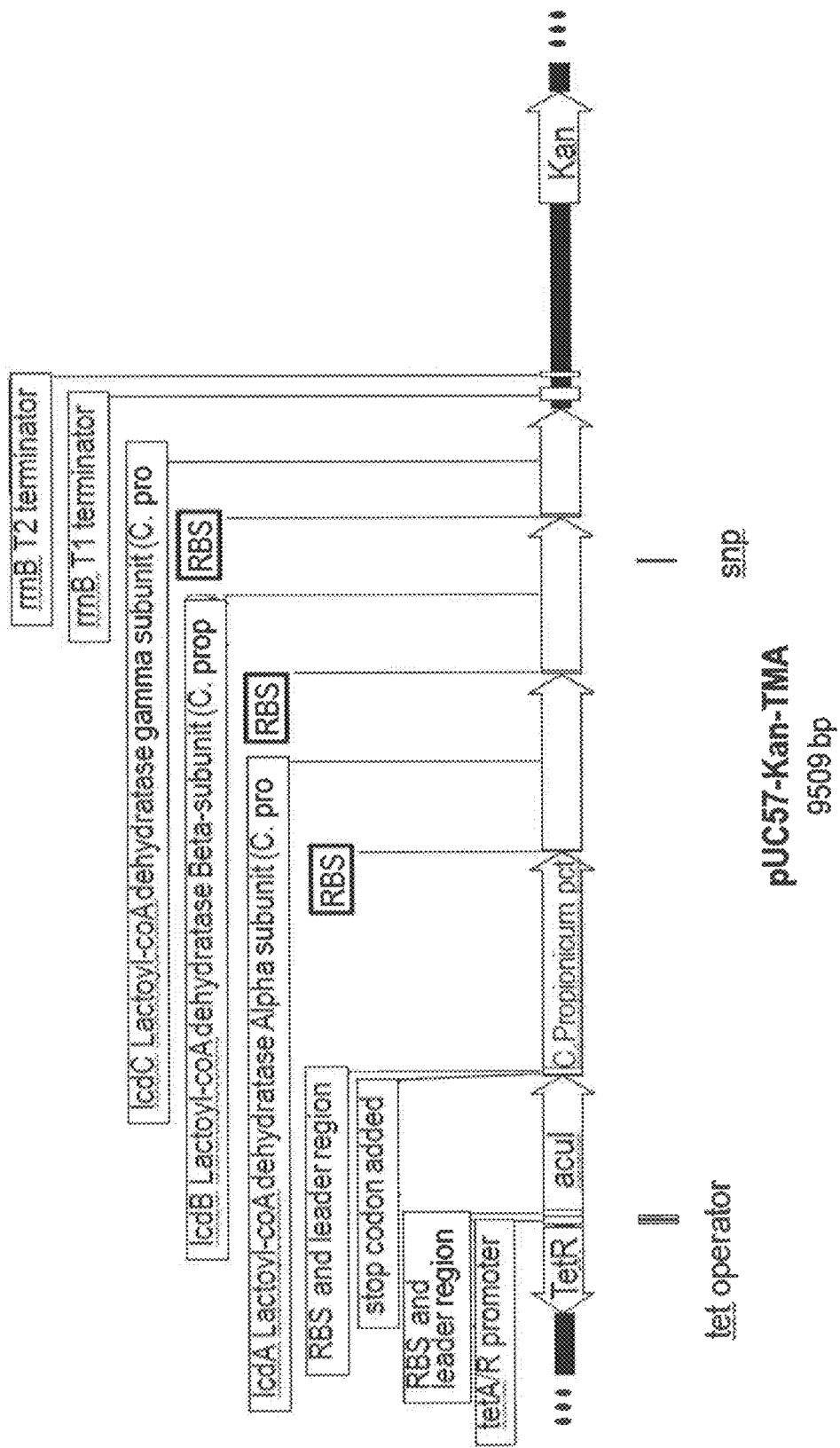
FIG. 27 depicts a schematic of an exemplary propionate biosynthesis gene cassette.

As seen in FIG. 26A and FIG. 26B, both integrated strains made similar amounts of acetate, and FNRS-ter-pbt-buk butyrate cassettes produced slightly more butyrate. Deletions in adhE and ldhA have similar effects on butyrate and acetate production. Acetate production was much greater in media containing 0.5% glucuronic acid.

In alternate embodiments, frd (fumarate reductase) is deleted to assess the effect of the deletion on acetate and butyrate production.

Example 21

Acetate and Butyrate Quantification in Bacterial Supernatant by LC-MS/MS

Sample Preparation

Ammonium acetate and Sodium butyrate stock (10 mg/mL) was prepared in water and aliquoted in 1.5 mL microcentrifuge tubes (100 μL) and stored at −20° C. Standards (1000, 500, 250, 100, 20, 4, 0.8 μg/mL) were prepared in water. Sample and standards (10 μL) were pipetted in a V-bottom polypropylene 96-well plate on ice. Derivatizing solution (90 μL) containing 50 mM of 2-Hydrazinoquinoline (2-HQ), dipyridyl disulfide, and triphenylphosphine in acetonitrile with 2 ug/mL of Sodium butyrate-d7 was added into the final solution. The plate was then heat-sealed with a ThermASeal foil and mixed well, and the samples were incubated at 60° C. for 1 hr for derivatization and centrifuged at 4000 rpm for 5 min. The derivatized samples (20 μL) were added to 180 μL of 0.1% formic acid in water/ACN (140:40) in a round-bottom 96-well plate. The plate was then heat-sealed with a Clear-ASeal sheet and mixed well.

LC-MS/MS Method

Derivatized metabolites were measured by liquid chromatography coupled to tandem mass spectrometry (LC-MS/MS) using a Thermo TSQ Quantum Max triple quadrupole mass spectrometer. Table 55 and Table 56 provides the summary of the LC-MS/MS MS/MS method

TABLE 55

| Column: | C18 column, 3 μm (100 x 2 mm) |
|---|---|
| Mobile Phase A: | 100% H2O, 0.1% Formic Acid |
| Mobile Phase B: | 100% ACN, 0.1% Formic Acid |
| Injection volume: | 10 uL |

TABLE 56

| HPLC Method: | | | |
| --- | --- | --- | --- |
| Time (min) | Flow Rate (μL/min) | A % | B % |
| 0 | 500 | 95 | 5 |
| 0.5 | 500 | 95 | 5 |
| 2.0 | 500 | 10 | 90 |
| 3.0 | 500 | 10 | 90 |
| 3.01 | 500 | 95 | 5 |
| 3.25 | 500 | 95 | 5 |

Table 57 summarizes Tandem Mass Spectrometry.

TABLE 57

| Tandem Mass Spectrometry: | |
| --- | --- |
| Ion Source: | HESI-II |
| Polarity: | Positive |
| SRM transitions: | |
| Acetate: | 202.1/143.1 |
| Butyrate: | 230.1/160.2 |
| Butyrate-d7: | 237.1/160.2 |

Example 22

Production of Propionate Through the Sleeping Beauty Mutase Pathway in Genetically Engineered E. coli BW25113 and Nissle In E. coli, a four gene operon, sbm-ygfD-ygfG-ygfH (sleeping beauty mutase pathway) has been shown to encode a putative cobalamin-dependent pathway with the ability to produce propionate from succinate in vitro. While the sleeping beauty mutase pathway is present in E. coli, it is not under the control of a strong promoter and has shown low activity in vivo.

The utility of this operon for the production of propionate was assessed. Because E. coli Nissle does not have the complete operon, initial experiments were conducted in E. coli K12 (BW25113).

First, the native promoter for the sleeping beauty mutase operon on the chromosome in the BW25113 strain was replaced with a fnr promoter (BW25113 ldhA::frt; PfnrS-SBM-cam). The sequence for this construct is provided in Table 58. Mutation of the lactate dehydrogenase gene (ldhA) reportedly increases propionate production, and this mutation is therefore also added in certain embodiments.

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 184, or 184, or a functional fragment thereof.

TABLE 58

| SBM Construct Sequences | |
| --- | --- |
| Description | Sequence |
| BW25113 fnrS SBM construct (BW25113 frt-cam-frt-PfnrS-sbm, ygfD, ygfG, ygfH), comprising rrnB terminator 1, rrnB terminator 2 (both italic, uppercase), cat promoter and cam resistance gene (encoded on the lagging strand underlined uppercase), frt sites (italic underlined), FNRS promoter bold lowercase, with RBS and leader region bold and underlined and FNR binding site in bold and italics); sleeping beauty operon (sbm, ygfD, ygfG, ygfH) bold and uppercase (SEQ ID NO: 183) | CAAATAAAACGAAAGGCTCAGTCGAAAGACTGG<br>GCCTTTCGTTTTATCTGTTGTTTGTCGGTGAACG<br>CTCTCCTGAGTAGGACAAATCCGCCGGGAGCG<br>GATTTGAACGTTGCGAAGCAACGGCCCGGA<br>GGGTGGCGGGCAGGACGCCCGCCATAAACT<br>GCCAGGCATCAAATTAAGCAGAAGGCCATCCT<br>GACGGATGGCCTTTTTGCGTGGCCAGTGCCAA<br>GCTTGCATGCAGATTGCAGCATTACACGTCT<br>TGAGCGATTGTGTAGGCTGGAGCTGCTTCGA<br>AGTTCCTATACTTTCTAGAGAATAGGAACTTCGG<br>AATAGGAACTTCATTTAAATGGCGCGCCTTAC<br>GCCCCGCCCTGCCACTCATCGCAGTACTGTT<br>GTATTCATTAAGCATCTGCCGACATGGAAGC<br>CATCACAAACGGCATGATGAACCTGAATCGC<br>CAGCGGCATCAGCACCTTGTCGCCTTGCGTA<br>TAATATTTGCCCATGGTGAAAACGGGGGCGA<br>AGAAGTTGTCCATATTGGCCACGTTTAAATC<br>AAAACTGGTGAAACTCACCCAGGGATTGGCT<br>GAGACGAAAAACATATTCTCAATAAACCCTT<br>TAGGGAAATAGGCCAGGTTTTCACCGTAACA<br>CGCCACATCTTGCGAATATATGTGTAGAAAC<br>TGCCGGAAATCGTCGTGGTATTCACTCCAGA<br>GCGATGAAAACGTTTCAGTTTGCTCATGGAA<br>AACGGTGTAACAAGGGTGAACACTATCCCAT<br>ATCACCAGCTCACCGTCTTTCATTGCCATAC<br>GTAATTCCGGATGAGCATTCATCAGGCGGGC<br>AAGAATGTGAATAAAGGCCGGATAAAACTTG<br>TGCTTATTTTTCTTTACGGTCTTTAAAAAGGC<br>CGTAATATCCAGCTGAACGGTCTGGTTATAG<br>GTACATTGAGCAACTGACTGAAATGCCTCAA<br>AATGTTCTTTACGATGCCATTGGGATATATC<br>AACGGTGGTATATCCAGTGATTTTTTTCTCC<br>ATTTTAGCTTCCTTAGCTCCTGAAAATCTCGA<br>CAACTCAAAAAATACGCCCGGTAGTGATCTT<br>ATTTCATTATGGTGAAAGTTGGAACCTCTTA<br>CGTGCCGATCAACGTCTCATTTTCGCCAAAA<br>GTTGGCCAGGGCTTCCCGGTATCAACAGGG<br>ACACCAGGATTTATTTATTCTGCGAAGTGAT<br>CTTCCGTCACAGGTAGGCGCGCCGAAGTTCC<br>TATACTTTCTAGAGAATAGGAACTTCGGAATAG<br>GAACTAAGGAGGATATTCATATGGACCATGG |

TABLE 58-continued

SBM Construct Sequences

| Description | Sequence |
|---|---|
| | CTAATTCCCAGGTACCagttgttcttattggtggtgttgcttt<br>atggttgcatcgtagtaaatggttgtaacaaaagcaattttccggctgtct<br>gtatacaaaaacgccgcaaagtttgagcgaagtcaataaactctctaccc<br>attcagggcaatatctctcttggatccaaagtgaactctagaaataattttg<br>tttaactttaagaaggagatatacatATGTCTAACGTGCAG<br>GAGTGGCAACAGCTTGCCAACAAGGAATTGA<br>GCCGTCGGGAGAAAACTGTCGACTCGCTGGT<br>TCATCAAACCGCGGAAGGGATCGCCATCAAG<br>CCGCTGTATACCGAAGCCGATCTCGATAATC<br>TGGAGGTGACAGGTACCCTTCCTGGTTTGCC<br>GCCCTACGTTCGTGGCCCGCGTGCCACTATG<br>TATACCGCCCAACCGTGGACCATCCGTCAGT<br>ATGCTGGTTTTTCAACAGCAAAAGAGTCCAA<br>CGCTTTTTATCGCCGTAACCTGGCCGCCGGG<br>CAAAAAGGTCTTTCCGTTGCGTTTGACCTTG<br>CCACCCACCGTGGCTACGACTCCGATAACCC<br>GCGCGTGGCGGGCGACGTCGGCAAAGCGGG<br>CGTCGCTATCGACACCGTGGAAGATATGAAA<br>GTCCTGTTCGACCAGATCCCGCTGGATAAAA<br>TGTCGGTTTCGATGACCATGAATGGCGCAGT<br>GCTACCAGTACTGGCGTTTTATATCGTCGCC<br>GCAGAAGAGCAAGGTGTTACACCTGATAAAC<br>TGACCGGCACCATTCAAAACGATATTCTCAA<br>AGAGTACCTCTGCCGCAACACCTATATTTAC<br>CCACCAAAACCGTCAATGCGCATTATCGCCG<br>ACATCATCGCCTGGTGTTCCGGCAACATGCC<br>GCGATTTAATACCATCAGTATCAGCGGTTAC<br>CACATGGGTGAAGCGGGTGCCAACTGCGTG<br>CAGCAGGTAGCATTTACGCTCGCTGATGGGA<br>TTGAGTACATCAAAGCAGCAATCTCTGCCGG<br>ACTGAAAATTGATGACTTCGCTCCTCGCCTG<br>TCGTTCTTCTTCGGCATCGGCATGGATCTGT<br>TTATGAACGTCGCCATGTTGCGTGCGGCACG<br>TTATTTATGGAGCGAAGCGGTCAGTGGATTT<br>GGCGCACAGGACCCGAAATCACTGGCGCTG<br>CGTACCCACTGCCAGACCTCAGGCTGGAGCC<br>TGACTGAACAGGATCCGTATAACAACGTTAT<br>CCGCACCACCATTGAAGCGCTGGCTGCGACG<br>CTGGGCGGTACTCAGTCACTGCATACCAACG<br>CCTTTGACGAAGCGCTTGGTTTGCCTACCGA<br>TTTCTCAGCACGCATTGCCCGCAACACCCAG<br>ATCATCATCCAGGAAGAATCAGAACTCTGCC<br>GCACCGTCGATCCACTGGCCGGATCCTATTA<br>CATTGAGTCGCTGACCGATCAAATCGTCAAA<br>CAAGCCAGAGCTATTATCCAACAGATCGACG<br>AAGCCGGTGGCATGGCGAAAGCGATCGAAG<br>CAGGTCTGCCAAAACGAATGATCGAAGAGGC<br>CTCAGCGCGCGAACAGTCGCTGATCGACCAG<br>GGCAAGCGTGTCATCGTTGGTGTCAACAAGT<br>ACAAACTGGATCACGAAGACGAAACCGATGT<br>ACTTGAGATCGACAACGTGATGGTGCGTAAC<br>GAGCAAATTGCTTCGCTGGAACGCATTCGCG<br>CCACCCGTGATGATGCCGCCGTAACCGCCGC<br>GTTGAACGCCCTGACTCACGCCGCACAGCAT<br>AACGAAAACCTGCTGGCTGCCGCTGTTAATG<br>CCGCTCGCGTTCGCGCCACCCTGGGTGAAAT<br>TTCCGATGCGCTGGAAGTCGCTTTCGACCGT<br>TATCTGGTGCCAAGCCAGTGTGTTACCGGCG<br>TGATTGCGCAAAGCTATCATCAGTCTGAGAA<br>ATCGGCCTCCGAGTTCGATGCCATTGTTGCG<br>CAAACGGAGCAGTTCCTTGCCGACAATGGTC<br>GTCGCCCGCGCATTCTGATCGCTAAGATGGG<br>CCAGGATGGACACGATCGCGGCGCGAAAGT<br>GATCGCCAGCGCCTATTCCGATCTCGGTTTC<br>GACGTAGATTTAAGCCCGATGTTCTCTACAC<br>CTGAAGAGATCGCCCGCCTGGCCGTAGAAAA<br>CGACGTTCACGTAGTGGGCGCATCCTCACTG<br>GCTGCCGGTCATAAAACGCTGATCCCGGAAC<br>TGGTCGAAGCGCTGAAAAAATGGGGACGCG<br>AAGATATCTGCGTGGTCGCGGGTGGCGTCAT<br>TCCGCCGCAGGATTACGCCTTCCTGCAAGAG<br>CGCGGCGTGGCGGCGATTTATGGTCCAGGT<br>ACACCTATGCTCGACAGTGTGCGCGACGTAC<br>TGAATCTGATAAGCCAGCATCATGATTAATG<br>AAGCCACGCTGGCAGAAAGTATTCGCCGCTT<br>ACGTCAGGGTGAGCGTGCCACACTCGCCCA |

TABLE 58-continued

SBM Construct Sequences

| Description | Sequence |
|---|---|
| | GGCCATGACGCTGGTGGAAAGCCGTCACCC |
| | GCGTCATCAGGCACTAAGTACGCAGCTGCTT |
| | GATGCCATTATGCCGTACTGCGGTAACACCC |
| | TGCGACTGGGCGTTACCGGCACCCCCGGCG |
| | CGGGGAAAAGTACCTTTCTTGAGGCCTTTGG |
| | CATGTTGTTGATTCGAGAGGGATTAAAGGTC |
| | GCGGTTATTGCGGTCGATCCCAGCAGCCCGG |
| | TCACTGGCGGTAGCATTCTCGGGGATAAAAC |
| | CCGCATGAATGACCTGGCGCGTGCCGAAGC |
| | GGCGTTTATTCGCCCGGTACCATCCTCCGGT |
| | CATCTGGGCGGTGCCAGTCAGCGAGCGCGG |
| | GAATTAATGCTGTTATGCGAAGCAGCGGGTT |
| | ATGACGTAGTGATTGTCGAAACGGTTGGCGT |
| | CGGGCAGTCGGAAACAGAAGTCGCCCGCAT |
| | GGTGGACTGTTTTATCTCGTTGCAAATTGCC |
| | GGTGGCGGCGATGATCTGCAGGGCATTAAA |
| | AAAGGGCTGATGGAAGTGGCTGATCTGATCG |
| | TTATCAACAAAGACGATGGCGATAACCATAC |
| | CAATGTCGCCATTGCCCGGCATATGTACGAG |
| | AGTGCCCTGCATATTCTGCGACGTAAATACG |
| | ACGAATGGCAGCCACGGGTTCTGACTTGTAG |
| | CGCACTGGAAAAACGTGGAATCGATGAGATC |
| | TGGCACGCCATCATCGACTTCAAAACCGCGC |
| | TAACTGCCAGTGGTCGTTTACAACAAGTGCG |
| | GCAACAACAATCGGTGGAATGGCTGCGTAAG |
| | CAGACCGAAGAAGAAGTACTGAATCACCTGT |
| | TCGCGAATGAAGATTTCGATCGCTATTACCG |
| | CCAGACGCTTTTAGCGGTCAAAAACAATACG |
| | CTCTCACCGCGCACCGGCCTGCGGCAGCTCA |
| | GTGAATTTATCCAGACGCAATATTTTGATTA |
| | AAGGAATTTTTATGTCTTATCAGTATGTTAAC |
| | GTTGTCACTATCAACAAAGTGGCGGTCATTG |
| | AGTTTAACTATGGCCGAAAACTTAATGCCTT |
| | AAGTAAAGTCTTTATTGATGATCTTATGCAG |
| | GCGTTAAGCGATCTCAACCGGCCGGAAATTC |
| | GCTGTATCATTTTGCGCGCACCGAGTGGATC |
| | CAAAGTCTTCTCCGCAGGTCACGATATTCAC |
| | GAACTGCCGTCTGGCGGTCGCGATCCGCTCT |
| | CCTATGATGATCCATTGCGTCAAATCACCCG |
| | CATGATCCAAAAATTCCCGAAACCGATCATT |
| | TCGATGGTGGAAGGTAGTGTTTGGGGTGGC |
| | GCATTTGAAATGATCATGAGTTCCGATCTGA |
| | TCATCGCCGCCAGTACCTCAACCTTCTCAAT |
| | GACGCCTGTAAACCTCGGCGTCCCGTATAAC |
| | CTGGTCGGCATTCACAACCTGACCCGCGACG |
| | CGGGCTTCCACATTGTCAAAGAGCTGATTTT |
| | TACCGCTTCGCCAATCACCGCCCAGCGCGCG |
| | CTGGCTGTCGGCATCCTCAACCATGTTGTGG |
| | AAGTGGAAGAACTGGAAGATTTCACCTTACA |
| | AATGGCGCACCACATCTCTGAGAAAGCGCCG |
| | TTAGCCATTGCCGTTATCAAAGAAGAGCTGC |
| | GTGTACTGGGCGAAGCACACACCATGAACTC |
| | CGATGAATTTGAACGTATTCAGGGGATGCGC |
| | CGCGCGGTGTATGACAGCGAAGATTACCAG |
| | GAAGGGATGAACGCTTTCCTCGAAAAACGTA |
| | AACCTAATTTCGTTGGTCATTAATCCCTGCGA |
| | ACGAAGGAGTAAAAATGGAAACTCAGTGGAC |
| | AAGGATGACCGCCAATGAAGCGGCAGAAATT |
| | ATCCAGCATAACGACATGGTGGCATTTAGCG |
| | GCTTTACCCCGGCGGGTTCGCCGAAAGCCCT |
| | ACCCACCGCGATTGCCCGCAGAGCTAACGAA |
| | CAGCATGAGGCCAAAAAGCCGTATCAAATTC |
| | GCCTTCTGACGGGTGCGTCAATCAGCGCCGC |
| | CGCTGACGATGTACTTTCTGACGCCGATGCT |
| | GTTTCCTGGCGTGCGCCATATCAAACATCGT |
| | CCGGTTTACGTAAAAAGATCAATCAGGGCGC |
| | GGTGAGTTTCGTTGACCTGCATTTGAGCGAA |
| | GTGGCGCAAATGGTCAATTACGGTTTCTTCG |
| | GCGACATTGATGTTGCCGTCATTGAAGCATC |
| | GGCACTGGCACCGGATGGTCGAGTCTGGTTA |
| | ACCAGCGGGATCGGTAATGCGCCGACCTGG |
| | CTGCTGCGGGCGAAGAAAGTGATCATTGAAC |
| | TCAATCACTATCACGATCCGCGCGTTGCAGA |
| | ACTGGCGGATATTGTGATTCCTGGCGCGCCA |
| | CCGCGGCGCAATAGCGTGTCGATCTTCCATG |
| | CAATGGATCGCGTCGGTACCGCTATGTGCA |

TABLE 58-continued

SBM Construct Sequences

| Description | Sequence |
|---|---|
| | AATCGATCCGAAAAAGATTGTCGCCGTCGTG<br>GAAACCAACTTGCCCGACGCCGGTAATATGC<br>TGGATAAGCAAAATCCCATGTGCCAGCAGAT<br>TGCCGATAACGTGGTCACGTTCTTATTGCAG<br>GAAATGGCGCATGGGCGTATTCCGCCGGAAT<br>TTCTGCCGCTGCAAAGTGGCGTGGGCAATAT<br>CAATAATGCGGTAATGGCGCGTCTGGGGGA<br>AAACCCGGTAATTCCTCCGTTTATGATGTAT<br>TCGGAAGTGCTACAGGAATCGGTGGTGCATT<br>TACTGGAAACCGGCAAAATCAGCGGGGCCA<br>GCGCCTCCAGCCTGACAATCTCGGCCGATTC<br>CCTGCGCAAGATTTACGACAATATGGATTAC<br>TTTGCCAGCCGCATTGTGTTGCGTCCGCAGG<br>AGATTTCCAATAACCCGGAAATCATCCGTCG<br>TCTGGGCGTCATCGCTCTGAACGTCGGCCTG<br>GAGTTTGATATTTACGGGCATGCCAACTCAA<br>CACACGTAGCCGGGGTCGATCTGATGAACG<br>GCATCGGCGGCAGCGGTGATTTTGAACGCAA<br>CGCGTATCTGTCGATCTTTATGGCCCCGTCG<br>ATTGCTAAAGAAGGCAAGATCTCAACCGTCG<br>TGCCAATGTGCAGCCATGTTGATCACAGCGA<br>ACACAGCGTCAAAGTGATCATCACCGAACAA<br>GGGATCGCCGATCTGCGCGGTCTTTCCCCGC<br>TTCAACGCGCCCGCACTATCATTGATAATTG<br>TGCACATCCTATGTATCGGGATTATCTGCAT<br>CGCTATCTGGAAAATGCGCCTGGCGGACATA<br>TTCACCACGATCTTAGCCACGTCTTCGACTT<br>ACACCGTAATTTAATTGCAACCGGCTCGATG<br>CTGGGTTAA |
| FNRS promoter bold lowercase, with RBS and leader region bold and underlined, and FNR binding site bold and italics); sleeping beauty operon (sbm, ygfD, ygfG, ygfH) bold and uppercase<br>(SEQ ID NO: 184) | agttgttcttattggtggtgttgctttatggttgcatcgtagtaaatggttgta<br>acaaaagcaattttccggctgtctgtatacaaaaacgccgcaaagt*ttga*<br>*gcgaagtcaa*taaactctctacccattcagggcaatatctctcttggatcc<br>aaagtgaa<u>ctctagaaataattttgtttaactttaagaaggagatatacat</u><br>ATGTCTAACGTGCAGGAGTGGCAACAGCTTG<br>CCAACAAGGAATTGAGCCGTCGGGAGAAAA<br>CTGTCGACTCGCTGGTTCATCAAACCGCGGA<br>AGGGATCGCCATCAAGCCGCTGTATACCGAA<br>GCCGATCTCGATAATCTGGAGGTGACAGGTA<br>CCCTTCCTGGTTTGCCGCCCTACGTTCGTGG<br>CCCGCGTGCCACTATGTATACCGCCCAACCG<br>TGGACCATCCGTCAGTATGCTGGTTTTTCAA<br>CAGCAAAAGAGTCCAACGCTTTTTATCGCCG<br>TAACCTGGCCGCCGGGCAAAAAGGTCTTTCC<br>GTTGCGTTTGACCTTGCCACCCACCGTGGCT<br>ACGACTCCGATAACCCGCGCGTGGCGGGCG<br>ACGTCGGCAAAGCGGGCGTCGCTATCGACA<br>CCGTGGAAGATATGAAAGTCCTGTTCGACCA<br>GATCCCGCTGGATAAAATGTCGGTTTCGATG<br>ACCATGAATGGCGCAGTGCTACCAGTACTGG<br>CGTTTTATATCGTCGCCGCAGAAGAGCAAGG<br>TGTTACACCTGATAAACTGACCGGCACCATT<br>CAAAACGATATTCTCAAAGAGTACCTCTGCC<br>GCAACACCTATATTTACCCACCAAAACCGTC<br>AATGCGCATTATCGCCGACATCATCGCCTGG<br>TGTTCCGGCAACATGCCGCGATTTAATACCA<br>TCAGTATCAGCGGTTACCACATGGGTGAAGC<br>GGGTGCCAACTGCGTGCAGCAGGTAGCATTT<br>ACGCTCGCTGATGGGATTGAGTACATCAAAG<br>CAGCAATCTCTGCCGGACTGAAAATTGATGA<br>CTTCGCTCCTCGCCTGTCGTTCTTCTTCGGC<br>ATCGGCATGGATCTGTTTATGAACGTCGCCA<br>TGTTGCGTGCGGCACGTTATTTATGGAGCGA<br>AGCGGTCAGTGGATTTGGCGCACAGGACCC<br>GAAATCACTGGCGCTGCGTACCCACTGCCAG<br>ACCTCAGGCTGGAGCCTGACTGAACAGGATC<br>CGTATAACAACGTTATCCGCACCACCATTGA<br>AGCGCTGGCTGCGACGCTGGGCGGTACTCA<br>GTCACTGCATACCAACGCCTTTGACGAAGCG<br>CTTGGTTTGCCTACCGATTTCTCAGCACGCA<br>TTGCCCGCAACACCCAGATCATCATCCAGGA<br>AGAATCAGAACTCTGCCGCACCGTCGATCCA<br>CTGGCCGGATCCTATTACATTGAGTCGCTGA<br>CCGATCAAATCGTCAAACAAGCCAGAGCTAT<br>TATCCAACAGATCGACGAAGCCGGTGGCATG<br>GCGAAAGCGATCGAAGCAGGTCTGCCAAAA |

TABLE 58-continued

SBM Construct Sequences

| Description | Sequence |
|---|---|
| | CGAATGATCGAAGAGGCCTCAGCGCGCGAA |
| | CAGTCGCTGATCGACCAGGGCAAGCGTGTCA |
| | TCGTTGGTGTCAACAAGTACAAACTGGATCA |
| | CGAAGACGAAACCGATGTACTTGAGATCGAC |
| | AACGTGATGGTGCGTAACGAGCAAATTGCTT |
| | CGCTGGAACGCATTCGCGCCACCCGTGATGA |
| | TGCCGCCGTAACCGCCGCGTTGAACGCCCTG |
| | ACTCACGCCGCACAGCATAACGAAAACCTGC |
| | TGGCTGCCGCTGTTAATGCCGCTCGCGTTCG |
| | CGCCACCCTGGGTGAAATTTCCGATGCGCTG |
| | GAAGTCGCTTTCGACCGTTATCTGGTGCCAA |
| | GCCAGTGTGTTACCGGCGTGATTGCGCAAAG |
| | CTATCATCAGTCTGAGAAATCGGCCTCCGAG |
| | TTCGATGCCATTGTTGCGCAAACGGAGCAGT |
| | TCCTTGCCGACAATGGTCGTCGCCCGCGCAT |
| | TCTGATCGCTAAGATGGGCCAGGATGGACAC |
| | GATCGCGGCGCGAAAGTGATCGCCAGCGCC |
| | TATTCCGATCTCGGTTTCGACGTAGATTTAA |
| | GCCCGATGTTCTCTACACCTGAAGAGATCGC |
| | CCGCCTGGCCGTAGAAAACGACGTTCACGTA |
| | GTGGGCGCATCCTCACTGGCTGCCGGTCATA |
| | AAACGCTGATCCCGGAACTGGTCGAAGCGCT |
| | GAAAAAATGGGGACGCGAAGATATCTGCGT |
| | GGTCGCGGGTGGCGTCATTCCGCCGCAGGA |
| | TTACGCCTTCCTGCAAGAGCGCGGCGTGGCG |
| | GCGATTTATGGTCCAGGTACACCTATGCTCG |
| | ACAGTGTGCGCGACGTACTGAATCTGATAAG |
| | CCAGCATCATGATTAATGAAGCCACGCTGGC |
| | AGAAAGTATTCGCCGCTTACGTCAGGGTGAG |
| | CGTGCCACACTCGCCCAGGCCATGACGCTGG |
| | TGGAAAGCCGTCACCCGCGTCATCAGGCACT |
| | AAGTACGCAGCTGCTTGATGCCATTATGCCG |
| | TACTGCGGTAACACCCTGCGACTGGGCGTTA |
| | CCGGCACCCCCGGCGCGGGGAAAAGTACCT |
| | TTCTTGAGGCCTTTGGCATGTTGTTGATTCG |
| | AGAGGGATTAAAGGTCGCGGTTATTGCGGTC |
| | GATCCCAGCAGCCCGGTCACTGGCGGTAGC |
| | ATTCTCGGGGATAAAACCCGCATGAATGACC |
| | TGGCGCGTGCCGAAGCGGCGTTTATTCGCCC |
| | GGTACCATCCTCCGGTCATCTGGGCGGTGCC |
| | AGTCAGCGAGCGCGGGAATTAATGCTGTTAT |
| | GCGAAGCAGCGGGTTATGACGTAGTGATTGT |
| | CGAAACGGTTGGCGTCGGGCAGTCGGAAAC |
| | AGAAGTCGCCCGCATGGTGGACTGTTTTATC |
| | TCGTTGCAAATTGCCGGTGGCGGCGATGATC |
| | TGCAGGGCATTAAAAAAGGGCTGATGGAAGT |
| | GGCTGATCTGATCGTTATCAACAAAGACGAT |
| | GGCGATAACCATACCAATGTCGCCATTGCCC |
| | GGCATATGTACGAGAGTGCCCTGCATATTCT |
| | GCGACGTAAATACGACGAATGGCAGCCACG |
| | GGTTCTGACTTGTAGCGCACTGGAAAAACGT |
| | GGAATCGATGAGATCTGGCACGCCATCATCG |
| | ACTTCAAAACCGCGCTAACTGCCAGTGGTCG |
| | TTTACAACAAGTGCGGCAACAACAATCGGTG |
| | GAATGGCTGCGTAAGCAGACCGAAGAAGAA |
| | GTACTGAATCACCTGTTCGCGAATGAAGATT |
| | TCGATCGCTATTACCGCCAGACGCTTTTAGC |
| | GGTCAAAAACAATACGCTCTCACCGCGCACC |
| | GGCCTGCGGCAGCTCAGTGAATTTATCCAGA |
| | CGCAATATTTTGATTAAAGGAATTTTTATGTC |
| | TTATCAGTATGTTAACGTTGTCACTATCAACA |
| | AAGTGGCGGTCATTGAGTTTAACTATGGCCG |
| | AAAACTTAATGCCTTAAGTAAAGTCTTTATTG |
| | ATGATCTTATGCAGGCGTTAAGCGATCTCAA |
| | CCGGCCGGAAATTCGCTGTATCATTTTGCGC |
| | GCACCGAGTGGATCCAAAGTCTTCTCCGCAG |
| | GTCACGATATTCACGAACTGCCGTCTGGCGG |
| | TCGCGATCCGCTCTCCTATGATGATCCATTG |
| | CGTCAAATCACCCGCATGATCCAAAAATTCC |
| | CGAAACCGATCATTTCGATGGTGGAAGGTAG |
| | TGTTTGGGGTGGCGCATTTGAAATGATCATG |
| | AGTTCCGATCTGATCATCGCCGCCAGTACCT |
| | CAACCTTCTCAATGACGCCTGTAAACCTCGG |
| | CGTCCCGTATAACCTGGTCGGCATTCACAAC |
| | CTGACCCGCGACGCGGGCTTCCACATTGTCA |
| | AAGAGCTGATTTTACCGCTTCGCCAATCAC |

TABLE 58-continued

SBM Construct Sequences

| Description | Sequence |
|---|---|
| | CGCCCAGCGCGCGCTGGCTGTCGGCATCCTC
AACCATGTTGTGGAAGTGGAAGAACTGGAAG
ATTTCACCTTACAAATGGCGCACCACATCTC
TGAGAAAGCGCCGTTAGCCATTGCCGTTATC
AAAGAAGAGCTGCGTGTACTGGGCGAAGCA
CACACCATGAACTCCGATGAATTTGAACGTA
TTCAGGGGATGCGCCGCGCGGTGTATGACA
GCGAAGATTACCAGGAAGGGATGAACGCTTT
CCTCGAAAAACGTAAACCTAATTTCGTTGGT
CATTAATCCCTGCGAACGAAGGAGTAAAAATG
GAAACTCAGTGGACAAGGATGACCGCCAATG
AAGCGGCAGAAATTATCCAGCATAACGACAT
GGTGGCATTTAGCGGCTTTACCCCGGCGGGT
TCGCCGAAAGCCCTACCCACCGCGATTGCCC
GCAGAGCTAACGAACAGCATGAGGCCAAAA
AGCCGTATCAAATTCGCCTTCTGACGGGTGC
GTCAATCAGCGCCGCCGCTGACGATGTACTT
TCTGACGCCGATGCTGTTTCCTGGCGTGCGC
CATATCAAACATCGTCCGGTTTACGTAAAAA
GATCAATCAGGGCGCGGTGAGTTTCGTTGAC
CTGCATTTGAGCGAAGTGGCGCAAATGGTCA
ATTACGGTTTCTTCGGCGACATTGATGTTGC
CGTCATTGAAGCATCGGCACTGGCACCGGAT
GGTCGAGTCTGGTTAACCAGCGGGATCGGTA
ATGCGCCGACCTGGCTGCTGCGGGCGAAGA
AAGTGATCATTGAACTCAATCACTATCACGA
TCCGCGCGTTGCAGAACTGGCGGATATTGTG
ATTCCTGGCGCGCCACCGCGGCGCAATAGC
GTGTCGATCTTCCATGCAATGGATCGCGTCG
GTACCCGCTATGTGCAAATCGATCCGAAAAA
GATTGTCGCCGTCGTGGAAACCAACTTGCCC
GACGCCGGTAATATGCTGGATAAGCAAAATC
CCATGTGCCAGCAGATTGCCGATAACGTGGT
CACGTTCTTATTGCAGGAAATGGCGCATGGG
CGTATTCCGCCGGAATTTCTGCCGCTGCAAA
GTGGCGTGGGCAATATCAATAATGCGGTAAT
GGCGCGTCTGGGGGAAAACCCGGTAATTCCT
CCGTTTATGATGTATTCGGAAGTGCTACAGG
AATCGGTGGTGCATTTACTGGAAACCGGCAA
AATCAGCGGGGCCAGCGCCTCCAGCCTGAC
AATCTCGGCCGATTCCCTGCGCAAGATTTAC
GACAATATGGATTACTTTGCCAGCCGCATTG
TGTTGCGTCCGCAGGAGATTTCCAATAACCC
GGAAATCATCCGTCGTCTGGGCGTCATCGCT
CTGAACGTCGGCCTGGAGTTTGATATTTACG
GGCATGCCAACTCAACACACGTAGCCGGGGT
CGATCTGATGAACGGCATCGGCGGCAGCGG
TGATTTTGAACGCAACGCGTATCTGTCGATC
TTTATGGCCCCGTCGATTGCTAAAGAAGGCA
AGATCTCAACCGTCGTGCCAATGTGCAGCCA
TGTTGATCACAGCGAACACAGCGTCAAAGTG
ATCATCACCGAACAAGGGATCGCCGATCTGC
GCGGTCTTTCCCCGCTTCAACGCGCCCGCAC
TATCATTGATAATTGTGCACATCCTATGTATC
GGGATTATCTGCATCGCTATCTGGAAAATGC
GCCTGGCGGACATATTCACCACGATCTTAGC
CACGTCTTCGACTTACACCGTAATTTAATTG
CAACCGGCTCGATGCTGGGTAA |

Next, this strain was tested for propionate production.

Briefly, 3 ml LB (containing selective antibiotics (cam) where necessary was inoculated from frozen glycerol stocks with either wild type *E. coli* K12 or the genetically engineered bacteria comprising the chromosomal sleeping beauty mutase operon under the control of a FNR promoter. Bacteria were grown overnight at 37 C with shaking. Overnight cultures were diluted 1:100 into 10 ml LB in a 125 ml baffled flask. Cultures were grown aerobically at 37 C with shaking for about 1.5 h, and then transferred to the anaerobic chamber at 37 C for 4 h. Bacteria ($2\times10^8$ CFU) were added to 1 ml M9 media containing 50 mM MOPS with 0.5% glucose in microcentrifuge tubes. Cells were plated to determine cell counts. The assay tubes were placed in the anaerobic chamber at 37 C. At 1, 2, and 24 hours, 120 ul of cells were removed and pelleted at 14,000 rpm for 1 min, and 100 ul of the supernatant was transferred to a 96-well assay plate and sealed with aluminum foil, and stored at −80 C until analysis by LC-MS for propionate concentrations, as described in Results are depicted in FIG. 29 and show that the genetically engineered strain produces ~2.5 mM after 24 h, while very little or no propionate production was detected from the *E. coli* K12 wild type strain. Propionate was measured as described in Example 25.

Example 23

Evaluation of the Sleeping Beauty Mutase Pathway for the Production of Propionate in *E coli Nissle*

Next, the SBM pathway is evaluated for propionate production in *E. coli* Nissle. Nissle does not have the full 4-gene sleeping beauty mutase operon; it only has the first gene and a partial gene of the second, and genes 3 and 4 are missing. Therefore, recombineering is used to introduce this pathway into Nissle. The frt-cam-frt-PfnrS-sbm, ygfD, ygfG, ygfH construct is inserted at the location of the endogenous, truncated Nissle SBM. Next, the construct is transformed into *E coli* Nissle and tested for propionate production essentially as described above.

Example 24

Evaluation of the Acrylate Pathway from *Clostridium propionicum* for Propionate Production The acrylate pathway from *Clostridium propionicum* is evaluated for adaptation to propionate production in *E. coli*. A construct (Ptet-pct-lcdABC-acrABC), codon optimized for *E. coli*, is synthesized by Genewiz and placed in a high copy plasmid (Logic051). Additionally, another construct is generated for side by side testing, in which the acrABC genes (which may be the rate limiting step of the pathway) are replaced with the acuI gene from *Rhodobacter sphaeroides* (Ptet-acuI-pct-lcdABC). Subsequently these constructs are transformed into BW25113 and are assessed for their ability to produce propionate, as compared to the type BW5113 strain as described above in Example 24. Propionate was measured as described in Example 27.

TABLE 59 of Exemplary Propionate Cassette Sequences

| Description and SEQ ID NO | Sequence |
|---|---|
| Ptet-pct-lcdABC-acrABC; Ptet: lower case; tertR/tetA promoter within Ptet: lower case bold, with tet operator: lower case bold underlined; ribosome binding site and leader: lowe case italic; ribosome binding sites: lower case underlined; coding regions: upper case; (SEQ ID NO: 185) | ttaagacccactttcacatttaagttgtttttctaatccgcatatgatcaattcaaggccgaataa gaaggctggctctgcaccttggtgatcaaataattcgatagcttgtcgtaataatggcggcat actatcagtagtaggtgtttccctttcttctttagcgacttgatgctcttgatcttccaatacgcaa cctaaagtaaaatgccccacagcgctgagtgcatataatgcattctctagtgaaaaaccttgt tggcataaaaaggctaattgattttcgagagtttcatactgtttttctgtaggccgtgtacctaa atgtactttttgctccatcgcgatgacttagtaaagcacatctaaaacttttagcgttattacgtaa aaaatcttgccagctttccccttctaaagggcaaaagtgagtatggtgcctatctaacatctca atggctaaggcgtcgagcaaagcccgcttattttttacatgccaatacaatgtaggctgctct acacctagcttctgggcgagtttacgggttgttaaaccttcgattccgacctcattaagcagct ctaatgcgctgttaatcactttacttttatctaatctagacatcattaattcctaatttttgttgaca ctctatcattgatagagttattttaccactccctatcagtgatagagaaaagtgaa*ctct agaaataatttttgtttaactttaa*gaaggagatatacatATGCGCAAAGTGCC GATTATCACGGCTGACGAGGCCGCAAAACTGATCAAG GACGGCGACACCGTGACAACTAGCGGCTTTGTGGGTA ACGCGATCCCTGAGGCCCTTGACCGTGCAGTCGAAAA GCGTTTCCTGGAAACGGGCGAACCGAAGAACATTACTT ATGTATATTGCGGCAGTCAGGGCAATCGCGACGGTCGT GGCGCAGAACATTTCGCGCATGAAGGCCTGCTGAAAC GTTATATCGCTGGCCATTGGGCGACCGTCCCGGCGTTA GGGAAAATGGCCATGGAGAATAAAATGGAGGCCTACA ATGTCTCTCAGGGCGCCTTGTGTCATCTCTTTCGCGATA TTGCGAGCCATAAACCGGGTGTGTTCACGAAAGTAGG AATCGGCACCTTCATTGATCCACGTAACGGTGGTGGGA AGGTCAACGATATTACCAAGGAAGATATCGTAGAACT GGTGGAAATTAAAGGGCAGGAATACCTGTTTTATCCGG CGTTCCCGATCCATGTCGCGCTGATTCGTGGCACCTAT GCGGACGAGAGTGGTAACATCACCTTTGAAAAAGAGG TAGCGCCTTTGGAAGGGACTTCTGTCTGTCAAGCGGTG AAGAACTCGGGTGGCATTGTCGTGGTTCAGGTTGAGCG TGTCGTCAAAGCAGGCACGCTGGATCCGCGCCATGTGA AAGTTCCGGGTATCTATGTAGATTACGTAGTCGTCGCG GATCCGGAGGACCATCAACAGTCCCTTGACTGCGAATA TGATCCTGCCCTTAGTGGAGAGCACCGTCGTCCGGAGG TGGTGGGTGAACCACTGCCTTTATCCGCGAAGAAAGTC ATCGGCCGCCGTGGCGCGATTGAGCTCGAGAAGACG TTGCAGTGAACCTTGGGGTAGGTGCACCTGAGTATGTG GCCTCCGTGGCCGATGAAGAAGGCATTGTGGATTTTAT GACTCTCACAGCGGAGTCCGGCGCTATCGGTGGCGTTC CAGCCGGCGGTGTTCGCTTTGGGGCGAGCTACAATGCT GACGCCTTGATCGACCAGGGCTACCAATTTGATTATTA CGACGGTGGGGGTCTGGATCTTTGTTACCTGGGTTTAG CTGAATGCGACGAAAAGGGTAATATCAATGTTAGCCG CTTCGGTCCTCGTATCGCTGGGTGCGGCGGATTCATTA ACATTACCCAAAACACGCCGAAAGTCTTCTTTTGTGGG ACCTTTACAGCCGGGGGGCTGAAAGTGAAAATTGAAG ATGTAAGGTGATTATCGTTCAGGAAGGGAAACAGAA GAAATTCCTTAAGGCAGTGGAGCAAATCACCTTTAATG |

TABLE 59-continued of Exemplary Propionate Cassette Sequences

| Description and SEQ ID NO | Sequence |
|---|---|
| | GAGACGTGGCCTTAGCGAACAAGCAACAAGTTACCTA<br>CATCACGGAGCGTTGCGTCTTCCTCCTCAAAGAAGACG<br>GTTTACACCTTTCGGAAATCGCGCCAGGCATCGATCTG<br>CAGACCCAGATTTTGGATGTTATGGACTTTGCCCCGAT<br>CATTGATCGTGACGCAAACGGGCAGATTAAACTGATG<br>GACGCGGCGTTATTCGCAGAAGGGCTGATGGGCTTGA<br>AGAAATGAAGTCTTGAtaagaaggagatatacatATGAGCTTA<br>ACCCAAGGCATGAAAGCTAAACAACTGTTAGCATACTT<br>TCAGGGTAAAGCCGATCAGGATGCACGTGAAGCGAAA<br>GCCCGCGGTGAGCTGGTCTGCTGGTCGGCGTCAGTCGC<br>GCCGCCGGAATTTTGCGTAACAATGGGCATTGCCATGA<br>TCTACCCGGAGACTCATGCAGCGGGCATCGGTGCCCGC<br>AAAGGTGCGATGGACATGCTGGAAGTTGCGGACCGCA<br>AAGGCTACAACGTGGATTGTTGTTCCTACGGCCGTGTA<br>AATATGGGTTACATGGAATGTTTAAAAGAAGCCGCCAT<br>CACGGGCGTCAAGCCGGAAGTTTTGGTTAATTCCCCTG<br>CTGCTGACGTTCCGCTTCCCGATTTGGTGATTACGTGTA<br>ATAATATCTGTAACACGCTGCTGAAATGGTACGAAAAC<br>TTAGCAGCAGAACTCGATATTCCTTGCATCGTGATCGA<br>CGTACCGTTTAATCATACCATGCCGATTCCGGAATATG<br>CCAAGGCCTACATCGCGGACCAGTTCCGCAATGCAATT<br>TCTCAGCTGGAAGTTATTTGTGGCCGTCCGTTCGATTG<br>GAAGAAATTTAAGGAGGTCAAAGATCAGACCCAGCGT<br>AGCGTATACCACTGGAACCGCATTGCCGAGATGGCGA<br>AATACAAGCCTAGCCCGCTGAACGGCTTCGATCTGTTC<br>AATTACATGGCGTTAATCGTGGCGTGCCGCAGCCTGGA<br>TTATGCAGAAATTACCTTTAAAGCGTTCGCGGACGAAT<br>TAGAAGAGAATTTGAAGGCGGGTATCTACGCCTTTAAA<br>GGTGCGGAAAAAACGCGCTTTCAATGGGAAGGTATCG<br>CGGTGTGGCCACATTTAGGTCACACGTTTAAATCTATG<br>AAGAATCTGAATTCGATTATGACCGGTACGGCATACCC<br>CGCCCTTTGGGACCTGCACTATGACGCTAACGACGAAT<br>CTATGCACTCTATGGCTGAAGCGTACACCCGTATTTAT<br>ATTAATACTTGTCTGCAGAACAAAGTAGAGGTCCTGCT<br>TGGGATCATGGAAAAAGGCCAGGTGGATGGTACCGTA<br>TATCATCTGAATCGCAGCTGCAAACTGATGAGTTTCCT<br>GAACGTGGAAACGGCTGAAATTATTAAAGAGAAGAAC<br>GGTCTTCCTTACGTCTCCATTGATGGCGATCAGACCGA<br>TCCTCGCGTTTTTTCTCCGGCCCAGTTTGATACCCGTGT<br>TCAGGCCCTGGTTGAGATGATGGAGGCCAATATGGCG<br>GCAGCGGAATAAtaagaaggagatatacatATGTCACGCGTGGA<br>GGCAATCCTGTCGCAGCTGAAAGATGTCGCCGCGAATC<br>CGAAAAAAGCCATGGATGACTATAAAGCTGAAACAGG<br>TAAGGGCGCGGTTGGTATCATGCCGATCTACAGCCCCG<br>AAGAAATGGTACACGCCGCTGGCTATTTGCCGATGGG<br>AATCTGGGGCGCCCAGGGCAAAACGATTAGTAAAGCG<br>CGCACCTATCTGCCTGCTTTTGCCTGCAGCGTAATGCA<br>GCAGGTTATGGAATTACAGTGCGAGGGCGCGTATGAT<br>GACCTGTCCGCAGTTATTTTTAGCGTACCGTGCGACAC<br>TCTCAAATGTCTTAGCCAGAAATGGAAAGGTACGTCCC<br>CAGTGATTGTATTTACGCATCCGCAGAACCGCGGATTA<br>GAAGCGGCGAACCAATTCTTGGTTACCGAGTATGAACT<br>GGTAAAAGCACAACTGGAATCAGTTCTGGGTGTGAAA<br>ATTTCAAACGCCGCCCTGGAAAATTCGATTGCAATTTA<br>TAACGAGAATCGTGCCGTGATGCGTGAGTTCGTGAAA<br>GTGGCAGCGGACTATCCTCAAGTCATTGACGCAGTGAG<br>CCGCCACGCGGTTTTTAAAGCGCGCCAGTTTATGCTTA<br>AGGAAAAACATACCGCACTTGTGAAAGAACTGATCGC<br>TGAGATTAAAGCAACGCCAGTCCAGCCGTGGGACGGA<br>AAAAAGGTTGTAGTGACGGGCATTCTGTTGGAACCGA<br>ATGAGTTATTAGATATCTTTAATGAGTTTAAGATCGCG<br>ATTGTTGATGATGATTTAGCGCAGGAAAGCCGTCAGAT<br>CCGTGTTGACGTTCTGGACGGAGAAGGCGGACCGCTCT<br>ACCGTATGGCTAAAGCGTGGCAGCAAATGTATGGCTG<br>CTCGCTGGCAACCGACACCAAGAAGGGTCGCGGCCGT<br>ATGTTAATTAACAAAACGATTCAGACCGGTGCGGACG<br>CTATCGTAGTTGCAATGATGAAGTTTTGCGACCCAGAA<br>GAATGGGATTATCCGGTAATGTACCGTGAATTTGAAGA<br>AAAAGGGGTCAAATCACTTATGATTGAGGTGGATCAG<br>GAAGTATCGTCTTTCGAACAGATTAAAACCCGTCTGCA<br>GTCATTCGTCGAAATGCTTTAAtaagaaggagatatacatATGTA<br>TACCTTGGGGATTGATGTCGGTTCTGCCTCTAGTAAAG<br>CGGTGATTCTGAAAGATGGAAAAGATATTGTCGCTGCC<br>GAGGTTGTCCAAGTCGGTACCGGCTCCTCGGGTCCCCA<br>ACGCGCACTGGACAAAGCCTTTGAAGTCTCTGGCTTAA |

TABLE 59-continued of Exemplary Propionate Cassette Sequences

| Description and SEQ ID NO | Sequence |
|---|---|
| | AAAAGGAAGACATCAGCTACACAGTAGCTACGGGCTA |
| | TGGGCGCTTCAATTTTAGCGACGCGGATAAACAGATTT |
| | CGGAAATTAGCTGTCATGCCAAAGGCATTTATTTCTTA |
| | GTACCAACTGCGCGCACTATTATTGACATTGGCGGCCA |
| | AGATGCGAAAGCCATCCGCCTGGACGACAAGGGGGGT |
| | ATTAAGCAATTCTTCATGAATGATAAATGCGCGGCGGG |
| | CACGGGGCGTTTCCTGGAAGTCATGGCTCGCGTACTTG |
| | AAACCACCCTGGATGAAATGGCTGAACTGGATGAACA |
| | GGCGACTGACACCGCTCCCATTTCAAGCACCTGCACGG |
| | TTTTCGCCGAAAGCGAAGTAATTAGCCAATTGAGCAAT |
| | GGTGTCTCACGCAACAACATCATTAAAGGTGTCCATCT |
| | GAGCGTTGCGTCACGTGCGTGTGGTCTGGCGTATCGCG |
| | GCGGTTTGGAGAAAGATGTTGTTATGACAGGTGGCGTG |
| | GCAAAAAATGCAGGGGTGGTGCGCGCGGTGGCGGGCG |
| | TTCTGAAGACCGATGTTATCGTTGCTCCGAATCCTCAG |
| | ACGACCGGTGCACTGGGGGCAGCGCTGTATGCTTATGA |
| | GGCCGCCCAGAAGAAGTAAtaagaaggagatatacatATGGCCT |
| | TCAATAGCGCAGATATTAATTCTTTCCGCGATATTTGG |
| | GTGTTTTGTGAACAGCGTGAGGGCAAACTGATTAACAC |
| | CGATTTCGAATTAATTAGCGAAGGTCGTAAACTGGCTG |
| | ACGAACGCGGAAGCAAACTGGTTGGAATTTTGCTGGG |
| | GCACGAAGTTGAAGAAATCGCAAAAGAATTAGGCGGC |
| | TATGGTGCGGACAAGGTAATTGTGTGCGATCATCCGGA |
| | ACTTAAATTTTACACTACGGATGCTTATGCCAAAGTTT |
| | TATGTGACGTCGTGATGGAAGAGAAACCGGAGGTAAT |
| | TTTGATCGGTGCCACCAACATTGGCCGTGATCTCGGAC |
| | CGCGTTGTGCTGCACGCTTGCACACGGGGCTGACGGCT |
| | GATTGCACGCACCTGGATATTGATATGAATAAATATGT |
| | GGACTTTCTTAGCACCAGTAGCACCTTGGATATCTCGT |
| | CGATGACTTTCCCTATGGAAGATACAAACCTTAAAATG |
| | ACGCGCCCTGCATTTGGCGGACATCTGATGGCAACGAT |
| | CATTTGTCCACGCTTCCGTCCCTGTATGAGCACAGTGC |
| | GCCCCGGAGTGATGAAGAAAGCGGAGTTCTCGCAGGA |
| | GATGGCGCAAGCATGTCAAGTAGTGACCCGTCACGTA |
| | AATTTGTCGGATGAAGACCTTAAAACTAAAGTAATTAA |
| | TATCGTGAAGGAAACGAAAAAGATTGTGGATCTGATC |
| | GGCGCAGAAATTATTGTGTCAGTTGGTCGTGGTATCTC |
| | GAAAGATGTCCAAGGTGGAATTGCACTGGCTGAAAAA |
| | CTTGCGGACGCATTTGGTAACGGTGTCGTGGGCGGCTC |
| | GCGCGCAGTGATTGATTCCGGCTGGTTACCTGCGGATC |
| | ATCAGGTTGGACAAACCGGTAAGACCGTGCACCCGAA |
| | AGTCTACGTGGCGCTGGGTATTAGTGGGGCTATCCAGC |
| | ATAAGGCTGGGATGCAAGACTCTGAACTGATCATTGCC |
| | GTCAACAAAGACGAAACGGCGCCTATCTTCGACTGCG |
| | CCGATTATGGCATCACCGGTGATTTATTTAAAATCGTA |
| | CCGATGATGATCGACGCGATCAAAGAGGGTAAAAACG |
| | CATGAtaagaaggagatatacatATGCGCATCTATGTGTGTGTGA |
| | AACAAGTCCCAGATACGAGCGGCAAGGTGGCCGTTAA |
| | CCCTGATGGGACCCTTAACCGTGCCTCAATGGCAGCGA |
| | TTATTAACCCGGACGATATGTCCGCGATCGAACAGGCA |
| | TTAAAACTGAAAGATGAAACCGGATGCCAGGTTACGG |
| | CGCTTACGATGGGTCCTCCTCCTGCCGAGGGCATGTTG |
| | CGCGAAATTATTGCAATGGGGGCCGACGATGGTGTGCT |
| | GATTTCGGCCCGTGAATTTGGGGGGTCCGATACCTTCG |
| | CAACCAGTCAAATTATTAGCGCGGCAATCCATAAATTA |
| | GGCTTAAGCAATGAAGACATGATCTTTTGCGGTCGTCA |
| | GGCCATTGACGGTGATACGGCCCAAGTCGGCCCTCAA |
| | ATTGCCGAAAAACTGAGCATCCCACAGGTAACCTATG |
| | GCGCAGGAATCAAAAAATCTGGTGATTTAGTGCTGGTG |
| | AAGCGTATGTTGGAGGATGGTTATATGATGATCGAAGT |
| | CGAAACTCCATGTCTGATTACCTGCATTCAGGATAAAG |
| | CGGTAAAACCACGTTACATGACTCTCAACGGTATTATG |
| | GAATGCTACTCCAAGCCGCTCCTCGTTCTCGATTACGA |
| | AGCACTGAAAGATGAACCGCTGATCGAACTTGATACC |
| | ATTGGGCTTAAAGGCTCCCCGACGAATATCTTTAAATC |
| | GTTTACGCCGCCTCAGAAAGGCGTTGGTGTCATGCTCC |
| | AAGGCACCGATAAGGAAAAAGTCGAGGATCTGGTGGA |
| | TAAGCTGATGCAGAAACATGTCATCTAAtaagaaggagatatac |
| | atATGTTCTTACTGAAGATTAAAAAAGAACGTATGAAA |
| | CGCATGGACTTTAGTTTAACGCGTGAACAGGAGATGTT |
| | AAAAAAACTGGCGCGTCAGTTTGCTGAGATCGAGCTG |
| | GAACCGGTGGCCGAAGAGATTGATCGTGAGCACGTTTT |
| | TCCTGCAGAAAACTTTAAGAAGATGGCGGAAATTGGC |
| | TTAACCGGCATTGGTATCCCGAAAGAATTTGGTGGCTC |
| | CGGTGGAGGCACCCTGGAGAAGGTCATTGCCGTGTCA |

TABLE 59-continued of Exemplary Propionate Cassette Sequences

| Description and SEQ ID NO | Sequence |
|---|---|
| | GAATTCGGCAAAAAGTGTATGGCCTCAGCTTCCATTTT<br>AAGCATTCATCTTATCGCGCCGCAGGCAATCTACAAAT<br>ATGGGACCAAAGAACAGAAAGAGACGTACCTGCCGCG<br>TCTTACCAAAGGTGGTGAACTGGGCGCCTTTGCGCTGA<br>CAGAACCAAACGCCGGAAGCGATGCCGGCGCGGTAAA<br>AACGACCGCGATTCTGGACAGCCAGACAAACGAGTAC<br>GTGCTGAATGGCACCAAATGCTTTATCAGCGGGGGCG<br>GGCGCGCGGGTGTTCTTGTAATTTTTGCGCTTACTGAA<br>CCGAAAAAAGGTCTGAAAGGGATGAGCGCGATTATCG<br>TGGAGAAAGGGACCCCGGGCTTCAGCATCGGCAAGGT<br>GGAGAGCAAGATGGGGATCGCAGGTTCGGAAACCGCG<br>GAACTTATCTTCGAAGATTGTCGCGTTCCGGCTGCCAA<br>CCTTTTAGGTAAAGAAGGCAAAGGCTTTAAAATTGCTA<br>TGGAAGCCCTGGATGGCGCCCGTATTGGCGTGGGCGCT<br>CAAGCAATCGGAATTGCCGAGGGGGCGATCGACCTGA<br>GTGTGAAGTACGTTCACGAGCGCATTCAATTTGGTAAA<br>CCGATCGCGAATCTGCAGGGAATTCAATGGTATATCGC<br>GGATATGGCGACCAAAACCGCCGCGGCACGCGCACTT<br>GTTGAGTTTGCAGCGTATCTTGAAGACGCGGGTAAACC<br>GTTCACAAAGGAATCTGCTATGTGCAAGCTGAACGCCT<br>CCGAAAACGCGCGTTTTGTGACAAATTTAGCTCTGCAG<br>ATTCACGGGGGTTACGGTTATATGAAAGATTATCCGTT<br>AGAGCGTATGTATCGCGATGCTAAGATTACGGAAATTT<br>ACGAGGGGACATCAGAAATCCATAAGGTGGTGATTGC<br>GCGTGAAGTAATGAAACGCTAA |
| pct-lcdABC-acrABC<br>(ribosome binding sites: lower case underlined; coding regions: upper case)<br>(SEQ ID NO: 186) | ATGCGCAAAGTGCCGATTATCACGGCTGACGAGGCCG<br>CAAAACTGATCAAGGACGGCGACACCGTGACAACTAG<br>CGGCTTTGTGGGTAACGCGATCCCTGAGGCCCTTGACC<br>GTGCAGTCGAAAAGCGTTTCCTGGAAACGGGCGAACC<br>GAAGAACATTACTTATGTATATTGCGGCAGTCAGGGCA<br>ATCGCGACGGTCGTGGCGCAGAACATTTCGCGCATGA<br>AGGCCTGCTGAAACGTTATATCGCTGGCCATTGGGCGA<br>CCGTCCCGGCGTTAGGGAAAATGGCCATGGAGAATAA<br>AATGGAGGCCTACAATGTCTCTCAGGGCGCCTTGTGTC<br>ATCTCTTTCGCGATATTGCGAGCCATAAACCGGGTGTG<br>TTCACGAAAGTAGGAATCGGCACCTTCATTGATCCACG<br>TAACGGTGGTGGGAAGGTCAACGATATTACCAAGGAA<br>GATATCGTAGAACTGGTGGAAATTAAAGGGCAGGAAT<br>ACCTGTTTTATCCGGCGTTCCCGATCCATGTCGCGCTG<br>ATTCGTGGCACCTATGCGGACGAGAGTGGTAACATCAC<br>CTTTGAAAAAGAGGTAGCGCCTTTGGAAGGGACTTCTG<br>TCTGTCAAGCGGTGAAGAACTCGGGTGGCATTGTCGTG<br>GTTCAGGTTGAGCGTGTCGTCAAAGCAGGCACGCTGG<br>ATCCGCGCCATGTGAAAGTTCCGGGTATCTATGTAGAT<br>TACGTAGTCGTCGCGGATCCGGAGGACCATCAACAGTC<br>CCTTGACTGCGAATATGATCCTGCCCTTAGTGGAGAGC<br>ACCGTCGTCCGGAGGTGGTGGGTGAACCACTGCCTTTA<br>TCCGCGAAGAAAGTCATCGGCCGCCGTGGCGCGATTG<br>AGCTCGAGAAAGACGTTGCAGTGAACCTTGGGGTAGG<br>TGCACCTGAGTATGTGGCCTCCGTGGCCGATGAAGAAG<br>GCATTGTGGATTTTATGACTCTCACAGCGGAGTCCGGC<br>GCTATCGGTGGCGTTCCAGCCGGCGGTGTTCGCTTTGG<br>GGCGAGCTACAATGCTGACGCCTTGATCGACCAGGGCT<br>ACCAATTTGATTATTACGACGGTGGGGGTCTGGATCTT<br>TGTTACCTGGGTTTAGCTGAATGCGACGAAAAGGGTAA<br>TATCAATGTTAGCCGCTTCGGTCCTCGTATCGCTGGGT<br>GCGGCGGATTCATTAACATTACCCAAAACACGCCGAA<br>AGTCTTCTTTTGTGGGACCTTTACAGCCGGGGGCTGA<br>AAGTGAAAATTGAAGATGGTAAGGTGATTATCGTTCA<br>GGAAGGGAAACAGAAGAAATTCCTTAAGGCAGTGGAG<br>CAAATCACCTTTAATGGAGACGTGGCCTTAGCGAACAA<br>GCAACAAGTTACCTACATCACGGAGCGTTGCGTCTTCC<br>TCCTCAAAGAAGACGGTTTACACCTTTCGGAAATCGCG<br>CCAGGCATCGATCTGCAGACCCAGATTTTGGATGTTAT<br>GGACTTTGCCCCGATCATTGATCGTGACGCAAACGGGC<br>AGATTAAACTGATGGACGCGGCGTTATTCGCAGAAGG<br>GCTGATGGGCTTGAAAGAAATGAAGTCTTGAt<u>aagaaggag</u><br><u>atatacat</u>ATGAGCTTAACCCAAGGCATGAAAGCTAAACAA<br>CTGTTAGCATACTTTCAGGGTAAAGCCGATCAGGATGC<br>ACGTGAAGCGAAAGCCCGCGGTGAGCTGGTCTGCTGG<br>TCGGCGTCAGTCGCGCCGCCGGAATTTTGCGTAACAAT<br>GGGCATTGCCATGATCTACCCGGAGACTCATGCAGCGG<br>GCATCGGTGCCCGCAAAGGTGCGATGGACATGCTGGA<br>AGTTGCGGACCGCAAAGGCTACAACGTGGATTGTTGTT |

TABLE 59-continued of Exemplary Propionate Cassette Sequences

| Description and SEQ ID NO | Sequence |
|---|---|
| | CCTACGGCCGTGTAAATATGGGTTACATGGAATGTTTA |
| | AAAGAAGCCGCCATCACGGGCGTCAAGCCGGAAGTTT |
| | TGGTTAATTCCCCTGCTGCTGACGTTCCGCTTCCCGATT |
| | TGGTGATTACGTGTAATAATATCTGTAACACGCTGCTG |
| | AAATGGTACGAAAACTTAGCAGCAGAACTCGATATTC |
| | CTTGCATCGTGATCGACGTACCGTTTAATCATACCATG |
| | CCGATTCCGGAATATGCCAAGGCCTACATCGCGGACCA |
| | GTTCCGCAATGCAATTTCTCAGCTGGAAGTTATTTGTG |
| | GCCGTCCGTTCGATTGGAAGAAATTTAAGGAGGTCAA |
| | AGATCAGACCCAGCGTAGCGTATACCACTGGAACCGC |
| | ATTGCCGAGATGGCGAAATACAAGCCTAGCCCGCTGA |
| | ACGGCTTCGATCTGTTCAATTACATGGCGTTAATCGTG |
| | GCGTGCCGCAGCCTGGATTATGCAGAAATTACCTTTAA |
| | AGCGTTCGCGGACGAATTAGAAGAGAATTTGAAGGCG |
| | GGTATCTACGCCTTTAAAGGTGCGGAAAAAACGCGCTT |
| | TCAATGGGAAGGTATCGCGGTGTGGCCACATTTAGGTC |
| | ACACGTTTAAATCTATGAAGAATCTGAATTCGATTATG |
| | ACCGGTACGGCATACCCCGCCCTTTGGGACCTGCACTA |
| | TGACGCTAACGACGAATCTATGCACTCTATGGCTGAAG |
| | CGTACACCCGTATTTATATTAATACTTGTCTGCAGAAC |
| | AAAGTAGAGGTCCTGCTTGGGATCATGGAAAAAGGCC |
| | AGGTGGATGGTACCGTATATCATCTGAATCGCAGCTGC |
| | AAACTGATGAGTTTCCTGAACGTGGAAACGGCTGAAA |
| | TTATTAAAGAGAAGAACGGTCTTCCTTACGTCTCCATT |
| | GATGGCGATCAGACCGATCCTCGCGTTTTTTCTCCGGC |
| | CCAGTTTGATACCCGTGTTCAGGCCCTGGTTGAGATGA |
| | TGGAGGCCAATATGGCGGCAGCGGAATAAtaagaaggagata |
| | tacatATGTCACGCGTGGAGGCAATCCTGTCGCAGCTGAA |
| | AGATGTCGCCGCGAATCCGAAAAAAGCCATGGATGAC |
| | TATAAAGCTGAAACAGGTAAGGGCGCGGTTGGTATCA |
| | TGCCGATCTACAGCCCCGAAGAAATGGTACACGCCGCT |
| | GGCTATTTGCCGATGGGAATCTGGGGCGCCCAGGGCA |
| | AAACGATTAGTAAAGCGCGCACCTATCTGCCTGCTTTT |
| | GCCTGCAGCGTAATGCAGCAGGTTATGGAATTACAGTG |
| | CGAGGGCGCGTATGATGACCTGTCCGCAGTTATTTTTA |
| | GCGTACCGTGCGACACTCTCAAATGTCTTAGCCAGAAA |
| | TGGAAAGGTACGTCCCCAGTGATTGTATTTACGCATCC |
| | GCAGAACCGCGGATTAGAAGCGGCGAACCAATTCTTG |
| | GTTACCGAGTATGAACTGGTAAAAGCACAACTGGAAT |
| | CAGTTCTGGGTGTGAAAATTTCAAACGCCGCCCTGGAA |
| | AATTCGATTGCAATTTATAACGAGAATCGTGCCGTGAT |
| | GCGTGAGTTCGTGAAAGTGGCAGCGGACTATCCTCAA |
| | GTCATTGACGCAGTGAGCCGCCACGCGGTTTTTAAAGC |
| | GCGCCAGTTTATGCTTAAGGAAAAACATACCGCACTTG |
| | TGAAAGAACTGATCGCTGAGATTAAAGCAACGCCAGT |
| | CCAGCCGTGGGACGGAAAAAAGGTTGTAGTGACGGGC |
| | ATTCTGTTGGAACCGAATGAGTTATTAGATATCTTTAA |
| | TGAGTTTAAGATCGCGATTGTTGATGATGATTTAGCGC |
| | AGGAAAGCCGTCAGATCCGTGTTGACGTTCTGGACGG |
| | AGAAGGCGGACCGCTCTACCGTATGGCTAAAGCGTGG |
| | CAGCAAATGTATGGCTGCTCGCTGGCAACCGACACCA |
| | AGAAGGGTCGCGGCCGTATGTTAATTAACAAAACGAT |
| | TCAGACCGGTGCGGACGCTATCGTAGTTGCAATGATGA |
| | AGTTTTGCGACCCAGAAGAATGGGATTATCCGGTAATG |
| | TACCGTGAATTTGAAGAAAAAGGGGTCAAATCACTTAT |
| | GATTGAGGTGGATCAGGAAGTATCGTCTTTCGAACAGA |
| | TTAAAACCCGTCTGCAGTCATTCGTCGAAATGCTTTAAt |
| | aagaaggagatatacatATGTATACCTTGGGGATTGATGTCGGT |
| | TCTGCCTCTAGTAAAGCGGTGATTCTGAAAGATGGAAA |
| | AGATATTGTCGCTGCCGAGGTTGTCCAAGTCGGTACCG |
| | GCTCCTCGGGTCCCCAACGCGCACTGGACAAAGCCTTT |
| | GAAGTCTCTGGCTTAAAAAAGGAAGACATCAGCTACA |
| | CAGTAGCTACGGGCTATGGGCGCTTCAATTTTAGCGAC |
| | GCGGATAAACAGATTTCGGAAATTAGCTGTCATGCCAA |
| | AGGCATTTATTTCTTAGTACCAACTGCGCGCACTATTA |
| | TTGACATTGGCGGCCAAGATGCGAAAGCCATCCGCCTG |
| | GACGACAAGGGGGGTATTAAGCAATTCTTCATGAATG |
| | ATAAATGCGCGGCGGGCACGGGGCGTTTCCTGGAAGT |
| | CATGGCTCGCGTACTTGAAACCACCCTGGATGAAATGG |
| | CTGAACTGGATGAACAGGCGACTGACACCGCTCCCATT |
| | TCAAGCACCTGCACGGTTTTCGCCGAAAGCGAAGTAAT |
| | TAGCCAATTGAGCAATGGTGTCTCACGCAACAACATCA |
| | TTAAAGGTGTCCATCTGAGCGTTGCGTCACGTGCGTGT |
| | GGTCTGGCGTATCGCGGCGGTTTGGAGAAAGATGTTGT |
| | TATGACAGGTGGCGTGGCAAAAAATGCAGGGGTGGTG |

TABLE 59-continued of Exemplary Propionate Cassette Sequences

| Description and SEQ ID NO | Sequence |
|---|---|
| | CGCGCGGTGGCGGGCGTTCTGAAGACCGATGTTATCGT<br>TGCTCCGAATCCTCAGACGACCGGTGCACTGGGGGCA<br>GCGCTGTATGCTTATGAGGCCGCCCAGAAGAAGTAAtaa<br>gaaggagatatacatATGGCCTTCAATAGCGCAGATATTAATTC<br>TTTCCGCGATATTTGGGTGTTTTGTGAACAGCGTGAGG<br>GCAAACTGATTAACACCGATTTCGAATTAATTAGCGAA<br>GGTCGTAAACTGGCTGACGAACGCGGAAGCAAACTGG<br>TTGGAATTTTGCTGGGGCACGAAGTTGAAGAAATCGCA<br>AAAGAATTAGGCGGCTATGGTGCGGACAAGGTAATTG<br>TGTGCGATCATCCGGAACTTAAATTTTACACTACGGAT<br>GCTTATGCCAAAGTTTTATGTGACGTCGTGATGGAAGA<br>GAAACCGGAGGTAATTTTGATCGGTGCCACCAACATTG<br>GCCGTGATCTCGGACCGCGTTGTGCTGCACGCTTGCAC<br>ACGGGGCTGACGGCTGATTGCACGCACCTGGATATTGA<br>TATGAATAAATATGTGGACTTTCTTAGCACCAGTAGCA<br>CCTTGGATATCTCGTCGATGACTTTCCCTATGGAAGAT<br>ACAAACCTTAAAATGACGCGCCCTGCATTTGGCGGACA<br>TCTGATGGCAACGATCATTTGTCCACGCTTCCGTCCCT<br>GTATGAGCACAGTGCGCCCCGGAGTGATGAAGAAAGC<br>GGAGTTCTCGCAGGAGATGGCGCAAGCATGTCAAGTA<br>GTGACCCGTCACGTAAATTTGTCGGATGAAGACCTTAA<br>AACTAAAGTAATTAATATCGTGAAGGAAACGAAAAAG<br>ATTGTGGATCTGATCGGCGCAGAAATTATTGTGTCAGT<br>TGGTCGTGGTATCTCGAAAGATGTCCAAGGTGGAATTG<br>CACTGGCTGAAAAACTTGCGGACGCATTTGGTAACGGT<br>GTCGTGGGCGGCTCGCGCGCAGTGATTGATTCCGGCTG<br>GTTACCTGCGGATCATCAGGTTGGACAAACCGGTAAG<br>ACCGTGCACCCGAAAGTCTACGTGGCGCTGGGTATTAG<br>TGGGGCTATCCAGCATAAGGCTGGGATGCAAGACTCT<br>GAACTGATCATTGCCGTCAACAAAGACGAAACGGCGC<br>CTATCTTCGACTGCGCCGATTATGGCATCACCGGTGAT<br>TTATTTAAAATCGTACCGATGATGATCGACGCGATCAA<br>AGAGGGTAAAAACGCATGAtaagaaggagatatacatATGCGCA<br>TCTATGTGTGTGTGAAACAAGTCCCAGATACGAGCGGC<br>AAGGTGGCCGTTAACCCTGATGGGACCCTTAACCGTGC<br>CTCAATGGCAGCGATTATTAACCCGGACGATATGTCCG<br>CGATCGAACAGGCATTAAAACTGAAAGATGAAACCGG<br>ATGCCAGGTTACGGCGCTTACGATGGGTCCTCCTCCTG<br>CCGAGGGCATGTTGCGCGAAATTATTGCAATGGGGGC<br>CGACGATGGTGTGCTGATTTCGGCCCGTGAATTTGGGG<br>GGTCCGATACCTTCGCAACCAGTCAAATTATTAGCGCG<br>GCAATCCATAAATTAGGCTTAAGCAATGAAGACATGA<br>TCTTTTGCGGTCGTCAGGCCATTGACGGTGATACGGCC<br>CAAGTCGGCCCTCAAATTGCCGAAAAACTGAGCATCCC<br>ACAGGTAACCTATGGCGCAGGAATCAAAAAATCTGGT<br>GATTTAGTGCTGGTGAAGCGTATGTTGGAGGATGGTTA<br>TATGATGATCGAAGTCGAAACTCCATGTCTGATTACCT<br>GCATTCAGGATAAAGCGGTAAAACCACGTTACATGAC<br>TCTCAACGGTATTATGGAATGCTACTCCAAGCCGCTCC<br>TCGTTCTCGATTACGAAGCACTGAAAGATGAACCGCTG<br>ATCGAACTTGATACCATTGGGCTTAAAGGCTCCCCGAC<br>GAATATCTTTAAATCGTTTACGCCGCCTCAGAAAGGCG<br>TTGGTGTCATGCTCCAAGGCACCGATAAGGAAAAAGT<br>CGAGGATCTGGTGGATAAGCTGATGCAGAAACATGTC<br>ATCTAAtaagaaggagatatacatATGTTCTTACTGAAGATTAAA<br>AAAGAACGTATGAAACGCATGGACTTTAGTTTAACGC<br>GTGAACAGGAGATGTTAAAAAAACTGGCGCGTCAGTT<br>TGCTGAGATCGAGCTGGAACCGGTGGCCGAAGAGATT<br>GATCGTGAGCACGTTTTTCCTGCAGAAAACTTTAAGAA<br>GATGGCGGAAATTGGCTTAACCGGCATTGGTATCCCGA<br>AAGAATTTGGTGGCTCCGGTGGAGGCACCCTGGAGAA<br>GGTCATTGCCGTGTCAGAATTCGGCAAAAAGTGTATGG<br>CCTCAGCTTCCATTTTAAGCATTCATCTTATCGCGCCGC<br>AGGCAATCTACAAATATGGGACCAAAGAACAGAAAGA<br>GACGTACCTGCCGCGTCTTACCAAAGGTGGTGAACTGG<br>GCGCCTTTGCGCTGACAGAACCAAACGCCGGAAGCGA<br>TGCCGGCGCGGTAAAAACGACCGCGATTCTGGACAGC<br>CAGACAAACGAGTACGTGCTGAATGGCACCAAATGCT<br>TTATCAGCGGGGCGGGCGCGCGGGTGTTCTTGTAATT<br>TTTGCGCTTACTGAACCGAAAAAAGGTCTGAAAGGGA<br>TGAGCGCGATTATCGTGGAGAAAGGGACCCCGGGCTT<br>CAGCATCGGCAAGGTGGAGAGCAAGATGGGGATCGCA<br>GGTTCGGAAACCGCGGAACTTATCTTCGAAGATTGTCG<br>CGTTCCGGCTGCCAACCTTTTAGGTAAAGAAGGCAAAG<br>GCTTTAAAATTGCTATGGAAGCCCTGGATGGCGCCCGT |

TABLE 59-continued of Exemplary Propionate Cassette Sequences

| Description and SEQ ID NO | Sequence |
|---|---|
| | ATTGGCGTGGGCGCTCAAGCAATCGGAATTGCCGAGG<br>GGGCGATCGACCTGAGTGTGAAGTACGTTCACGAGCG<br>CATTCAATTTGGTAAACCGATCGCGAATCTGCAGGGAA<br>TTCAATGGTATATCGCGGATATGGCGACCAAAACCGCC<br>GCGGCACGCGCACTTGTTGAGTTTGCAGCGTATCTTGA<br>AGACGCGGGTAAACCGTTCACAAAGGAATCTGCTATG<br>TGCAAGCTGAACGCCTCCGAAAACGCGCGTTTTGTGAC<br>AAATTTAGCTCTGCAGATTCACGGGGGTTACGGTTATA<br>TGAAAGATTATCCGTTAGAGCGTATGTATCGCGATGCT<br>AAGATTACGGAAATTTACGAGGGGACATCAGAAATCC<br>ATAAGGTGGTGATTGCGCGTGAAGTAATGAAACGCTAA |
| Ptet-acuI-pct-lcdABC (Ptet: lower case; tetA/R promoter within Ptet: lower case bold, with tet operator underlined; RBS and leader region lower case italic; ribosome binding site: lower case underlined italic; coding region: upper case, rrnB T1 and T2 terminors: lower case bold underline italics) (SEQ ID NO: 187) | caactgttgggaagggcgatcggtgcgggcctcttcgctattacgccagctggcgaaagg<br>gggatgtgctgcaaggcgattaagttgggtaacgccagggttttcccagtcacgacgttgta<br>aaacgacggccagtgaattgacgcgtattgggatgtaaaacgacggccagtgaattcgtta<br>agacccactttcacatttaagttgttttctaatccgcatatgatcaattcaaggccgaataaga<br>aggctggctctgcaccttggtgatcaaataattcgatagcttgtcgtaataatggcggcatac<br>tatcagtagtaggtgtttcccttttcttcttagcgacttgatgctcttgatcttccaatacgcaacc<br>taaagtaaaatgccccacagcgctgagtgcatataatgcattctctagtgaaaaaccttgttg<br>gcataaaaaggctaatttttcgagagtttcatactgttttctgtaggccgtgtacctaaat<br>gtacttttgctccatcgcgatgacttagtaaagcacatctaaaacttttagcgttattacgtaaa<br>aaatcttgccagctttcccttctaaagggcaaaagtgagtatggtgcctatctaacatctcaa<br>tggctaaggcgtcgagcaaagcccgcttattttttacatgccaatacaatgtaggctgctcta<br>cacctagcttctgggcgagtttacgggttgttaaaccttcgattccgacctcattaagcagctc<br>taatgcgctgttaatcactttacttttatctaatctagacatcattaattcctaatttttt<b>gttgacac<br>tctatcattgatagagttatttaccactccctatcagtgatagaga</b>aaagtgaa<i>ctcta<br>gaaataattttgtttaactttaa<u>gaaggagatatacat</u></i>ATGCGTGCGGTACTG<br>ATCGAGAAGTCCGATGATACACAGTCCGTCTCTGTCAC<br>CGAACTGGCTGAAGATCAACTGCCGGAAGGCGACGTT<br>TTGGTAGATGTTGCTTATTCAACACTGAACTACAAAGA<br>CGCCCTGGCAATTACCGGTAAAGCCCCCGTCGTTCGTC<br>GTTTTCCGATGGTACCTGGAATCGACTTTACGGGTACC<br>GTGGCCCAGTCTTCCCACGCCGACTTCAAGCCAGGTGA<br>TCGCGTAATCCTGAATGGTTGGGGTGTGGGGGAAAAA<br>CATTGGGGCGGTTTAGCGGAGCGCGCTCGCGTGCGCG<br>GAGACTGGCTTGTTCCCTTGCCAGCCCCCCTGGACTTA<br>CGCCAAGCGGCCATGATCGGTACAGCAGGATACACGG<br>CGATGTTGTGCGTTCTGGCGCTTGAACGTCACGGAGTG<br>GTGCCGGGTAATGGGGAAATCGTGGTGTCCGGTGCAG<br>CAGGCGGCGTCGGCTCCGTTGCGACGACCCTTCTTGCC<br>GCTAAGGGCTATGAGGTAGCGGCAGTGACTGGACGTG<br>CGTCCGAAGCAGAATATCTGCGCGGTTTGGGGGCGGC<br>GAGCGTAATTGATCGTAACGAATTAACGGGGAAGGTA<br>CGCCCGCTGGGTCAGGAGCGTTGGGCTGGCGGGATTG<br>ACGTGGCGGGATCAACCGTGCTTGCGAACATGCTTTCT<br>ATGATGAAGTATCGCGGGGTAGTCGCTGCGTGTGGCCT<br>GGCCGCGGGCATGGATCTGCCCGCGTCTGTCGCGCCCT<br>TTATTCTTCGTGGGATGACGCTGGCAGGGGTGGATAGC<br>GTTATGTGCCCAAAGACAGATCGTTTAGCAGCGTGGGC<br>CCGTTTGGCGTCAGATCTTGACCCTGCCAAGCTGGAGG<br>AGATGACTACAGAGTTGCCGTTTAGTGAAGTAATCGAG<br>ACAGCACCCAAATTCTTGGACGGGACGGTTCGTGGCCG<br>CATTGTTATCCCCGTAACGCCCTAAga<i>actctagaaataattttgttt<br>aactttaa<u>gaaggagatatacat</u></i>ATGCGCAAAGTGCCGATTATCAC<br>GGCTGACGAGGCCGCAAAACTGATCAAGGACGGCGAC<br>ACCGTGACAACTAGCGGCTTTGTGGGTAACGCGATCCC<br>TGAGGCCCTTGACCGTGCAGTCGAAAAGCGTTTCCTGG<br>AAACGGGCGAACCGAAGAACATTACTTATGTATATTGC<br>GGCAGTCAGGGCAATCGCGACGGTCGTGGCGCAGAAC<br>ATTTCGCGCATGAAGGCCTGCTGAAACGTTATATCGCT<br>GGCCATTGGGCGACCGTCCCGGCGTTAGGGAAAATGG<br>CCATGGAGAATAAAATGGAGGCCTACAATGTCTCTCA<br>GGGCGCCTTGTGTCATCTCTTTCGCGATATTGCGAGCC<br>ATAAACCGGGTGTGTTCACGAAAGTAGGAATCGGCAC<br>CTTCATTGATCCACGTAACGGTGGTGGGAAGGTCAACG<br>ATATTACCAAGGAAGATATCGTAGAACTGGTGGAAAT<br>TAAAGGGCAGGAATACCTGTTTTATCCGGCGTTCCCGA<br>TCCATGTCGCGCTGATTCGTGGCACCTATGCGGACGAG<br>AGTGGTAACATCACCTTTGAAAAAGAGGTAGCGCCTTT<br>GGAAGGGACTTCTGTCTGTCAAGCGGTGAGAACTCG<br>GGTGGCATTGTCGTGGTTCAGGTTGAGCGTGTCGTCAA<br>AGCAGGCACGCTGGATCCGCGCCATGTGAAAGTTCCG<br>GGTATCTATGTAGATTACGTAGTCGTCGCGGATCCGGA<br>GGACCATCAACAGTCCCTTGACTGCGAATATGATCCTG<br>CCCTTAGTGGAGAGCACCGTCGTCCGGAGGTGGTGGGT |

TABLE 59-continued of Exemplary Propionate Cassette Sequences

| Description and SEQ ID NO | Sequence |
|---|---|
| | GAACCACTGCCTTTATCCGCGAAGAAAGTCATCGGCCG |
| | CCGTGGCGCGATTGAGCTCGAGAAAGACGTTGCAGTG |
| | AACCTTGGGGTAGGTGCACCTGAGTATGTGGCCTCCGT |
| | GGCCGATGAAGAAGGCATTGTGGATTTTATGACTCTCA |
| | CAGCGGAGTCCGGCGCTATCGGTGGCGTTCCAGCCGGC |
| | GGTGTTCGCTTTGGGGCGAGCTACAATGCTGACGCCTT |
| | GATCGACCAGGGCTACCAATTTGATTATTACGACGGTG |
| | GGGGTCTGGATCTTTGTTACCTGGGTTTAGCTGAATGC |
| | GACGAAAAGGGTAATATCAATGTTAGCCGCTTCGGTCC |
| | TCGTATCGCTGGGTGCGGCGGATTCATTAACATTACCC |
| | AAAACACGCCGAAAGTCTTCTTTTGTGGGACCTTTACA |
| | GCCGGGGGGCTGAAAGTGAAAATTGAAGATGGTAAGG |
| | TGATTATCGTTCAGGAAGGGAAACAGAAGAAATTCCTT |
| | AAGGCAGTGGAGCAAATCACCTTTAATGGAGACGTGG |
| | CCTTAGCGAACAAGCAACAAGTTACCTACATCACGGA |
| | GCGTTGCGTCTTCCTCCTCAAAGAAGACGGTTTACACC |
| | TTTCGGAAATCGCGCCAGGCATCGATCTGCAGACCCAG |
| | ATTTTGGATGTTATGGACTTTGCCCCGATCATTGATCGT |
| | GACGCAAACGGGCAGATTAAACTGATGGACGCGGCGT |
| | TATTCGCAGAAGGGCTGATGGGCTTGAAAGAAATGAA |
| | GTCTTGAt aa*gaaggagatatacat*ATGAGCTTAACCCAAGGCA |
| | TGAAAGCTAAACAACTGTTAGCATACTTTCAGGGTAAA |
| | GCCGATCAGGATGCACGTGAAGCGAAAGCCCGCGGTG |
| | AGCTGGTCTGCTGGTCGGCGTCAGTCGCGCCGCCGGAA |
| | TTTTGCGTAACAATGGGCATTGCCATGATCTACCCGGA |
| | GACTCATGCAGCGGGCATCGGTGCCCGCAAAGGTGCG |
| | ATGGACATGCTGGAAGTTGCGGACCGCAAAGGCTACA |
| | ACGTGGATTGTTGTTCCTACGGCCGTGTAAATATGGGT |
| | TACATGGAATGTTTAAAAGAAGCCGCCATCACGGGCG |
| | TCAAGCCGGAAGTTTTGGTTAATTCCCCTGCTGCTGAC |
| | GTTCCGCTTCCCGATTGGTGATTACGTGTAATAATATC |
| | TGTAACACGCTGCTGAAATGGTACGAAAACTTAGCAG |
| | CAGAACTCGATATTCCTTGCATCGTGATCGACGTACCG |
| | TTTAATCATACCATGCCGATTCCGGAATATGCCAAGGC |
| | CTACATCGCGGACCAGTTCCGCAATGCAATTTCTCAGC |
| | TGGAAGTTATTTGTGGCCGTCCGTTCGATTGGAAGAAA |
| | TTTAAGGAGGTCAAAGATCAGACCCAGCGTAGCGTAT |
| | ACCACTGGAACCGCATTGCCGAGATGGCGAAATACAA |
| | GCCTAGCCCGCTGAACGGCTTCGATCTGTTCAATTACA |
| | TGGCGTTAATCGTGGCGTGCCGCAGCCTGGATTATGCA |
| | GAAATTACCTTTAAAGCGTTCGCGGACGAATTAGAAG |
| | AGAATTTGAAGGCGGGTATCTACGCCTTTAAAGGTGCG |
| | GAAAAAACGCGCTTTCAATGGGAAGGTATCGCGGTGT |
| | GGCCACATTTAGGTCACACGTTTAAATCTATGAAGAAT |
| | CTGAATTCGATTATGACCGGTACGGCATACCCCGCCCT |
| | TTGGGACCTGCACTATGACGCTAACGACGAATCTATGC |
| | ACTCTATGGCTGAAGCGTACACCCGTATTTATATTAAT |
| | ACTTGTCTGCAGAACAAAGTAGAGGTCCTGCTTGGGAT |
| | CATGGAAAAGGCCAGGTGGATGGTACCGTATATCAT |
| | CTGAATCGCAGCTGCAAACTGATGAGTTTCCTGAACGT |
| | GGAAACGGCTGAAATTATTAAAGAGAAGAACGGTCTT |
| | CCTTACGTCTCCATTGATGGCGATCAGACCGATCCTCG |
| | CGTTTTTTCTCCGGCCCAGTTTGATACCCGTGTTCAGGC |
| | CCTGGTTGAGATGATGGAGGCCAATATGGCGGCAGCG |
| | GAATAAt aa*gaaggagatatacat*ATGTCACGCGTGGAGGCAAT |
| | CCTGTCGCAGCTGAAAGATGTCGCCGCGAATCCGAAA |
| | AAAGCCATGGATGACTATAAAGCTGAAACAGGTAAGG |
| | GCGCGGTTGGTATCATGCCGATCTACAGCCCCGAAGAA |
| | ATGGTACACGCCGCTGGCTATTTGCCGATGGGAATCTG |
| | GGGCGCCCAGGGCAAAACGATTAGTAAAGCGCGCACC |
| | TATCTGCCTGCTTTTGCCTGCAGCGTAATGCAGCAGGT |
| | TATGGAATTACAGTGCGAGGGCGCGTATGATGACCTGT |
| | CCGCAGTTATTTTTAGCGTACCGTGCGACACTCTCAAA |
| | TGTCTTAGCCAGAAATGGAAAGGTACGTCCCCAGTGAT |
| | TGTATTTACGCATCCGCAGAACCGCGGATTAGAAGCGG |
| | CGAACCAATTCTTGGTTACCGAGTATGAACTGGTAAAA |
| | GCACAACTGGAATCAGTTCTGGGTGTGAAAATTTCAAA |
| | CGCCGCCCTGGAAAATTCGATTGCAATTTATAACGAGA |
| | ATCGTGCCGTGATGCGTGAGTTCGTGAAAGTGGCAGCG |
| | GACTATCCTCAAGTCATTGACGCAGTGAGCCGCCACGC |
| | GGTTTTTAAAGCGCGCCAGTTTATGCTTAAGGAAAAAC |
| | ATACCGCACTTGTGAAAGAACTGATCGCTGAGATTAAA |
| | GCAACGCCAGTCCAGCCGTGGGACGGAAAAAAGGTTG |
| | TAGTGACGGGCATTCTGTTGGAACCGAATGAGTTATTA |
| | GATATCTTTAATGAGTTTAAGATCGCGATTGTTGATGA |

TABLE 59-continued of Exemplary Propionate Cassette Sequences

| Description and SEQ ID NO | Sequence |
|---|---|
| | TGATTTAGCGCAGGAAAGCCGTCGGATCCGTGTTGACG<br>TTCTGGACGGAGAAGGCGGACCGCTCTACCGTATGGCT<br>AAAGCGTGGCAGCAAATGTATGGCTGCTCGCTGGCAA<br>CCGACACCAAGAAGGGTCGCGGCCGTATGTTAATTAA<br>CAAAACGATTCAGACCGGTGCGGACGCTATCGTAGTTG<br>CAATGATGAAGTTTTGCGACCCAGAAGAATGGGATTAT<br>CCGGTAATGTACCGTGAATTTGAAGAAAAAGGGGTCA<br>AATCACTTATGATTGAGGTGGATCAGGAAGTATCGTCT<br>TTCGAACAGATTAAAACCCGTCTGCAGTCATTCGTCGA<br>AATGCTTTAAtaa*gaaggagatatacat*ATGTATACCTTGGGGA<br>TTGATGTCGGTTCTGCCTCTAGTAAAGCGGTGATTCTG<br>AAAGATGGAAAAGATATTGTCGCTGCCGAGGTTGTCC<br>AAGTCGGTACCGGCTCCTCGGGTCCCCAACGCGCACTG<br>GACAAAGCCTTTGAAGTCTCTGGCTTAAAAAAGGAAG<br>ACATCAGCTACACAGTAGCTACGGGCTATGGGCGCTTC<br>AATTTTAGCGACGCGGATAAACAGATTTCGGAAATTAG<br>CTGTCATGCCAAAGGCATTTATTTCTTAGTACCAACTG<br>CGCGCACTATTATTGACATTGGCGGCCAAGATGCGAAA<br>GCCATCCGCCTGGACGACAAGGGGGGTATTAAGCAAT<br>TCTTCATGAATGATAAATGCGCGGCGGGCACGGGGCG<br>TTTCCTGGAAGTCATGGCTCGCGTACTTGAAACCACCC<br>TGGATGAAATGGCTGAACTGGATGAACAGGCGACTGA<br>CACCGCTCCCATTTCAAGCACCTGCACGGTTTTCGCCG<br>AAAGCGAAGTAATTAGCCAATTGAGCAATGGTGTCTC<br>ACGCAACAACATCATTAAAGGTGTCCATCTGAGCGTTG<br>CGTCACGTGCGTGTGGTCTGGCGTATCGCGGCGGTTTG<br>GAGAAAGATGTTGTTATGACAGGTGGCGTGGCAAAAA<br>ATGCAGGGGTGGTGCGCGCGGTGGCGGGCGTTCTGAA<br>GACCGATGTTATCGTTGCTCCGAATCCTCAGACGACCG<br>GTGCACTGGGGGCAGCGCTGTATGCTTATGAGGCCGCC<br>CAGAAGAAGTA*gatggtagtgtgggg*tctccccatgcgagagtagggaactgc<br>caggcatcaaataaaacgaaaggctcagtcgaaagactgggcctttcgttttatctgttgt<br>ttgtcggtgaacgctctcctgagtaggacaaatccgccgggagcggatttgaacgttgcg<br>aagcaacggcccggagggtggcgggcaggacgcccgccataaactgccaggcatcaa<br>attaagcagaaggccatcctgacggatggccttttt |
| acuI-pct-lcdABC (SEQ ID NO: 188) | ATGCGTGCGGTACTGATCGAGAAGTCCGATGATACAC<br>AGTCCGTCTCTGTCACCGAACTGGCTGAAGATCAACTG<br>CCGGAAGGCGACGTTTTGGTAGATGTTGCTTATTCAAC<br>ACTGAACTACAAAGACGCCCTGGCAATTACCGGTAAA<br>GCCCCCGTCGTTCGTCGTTTTCCGATGGTACCTGGAAT<br>CGACTTTACGGGTACCGTGGCCCAGTCTTCCCACGCCG<br>ACTTCAAGCCAGGTGATCGCGTAATCCTGAATGGTTGG<br>GGTGTGGGGGAAAAACATTGGGGCGGTTTAGCGGAGC<br>GCGCTCGCGTGCGCGGAGACTGGCTTGTTCCCTTGCCA<br>GCCCCCCTGGACTTACGCCAAGCGGCCATGATCGGTAC<br>AGCAGGATACACGGCGATGTTGTGCGTTCTGGCGCTTG<br>AACGTCACGGAGTGGTGCCGGGTAATGGGGAAATCGT<br>GGTGTCCGGTGCAGCAGGCGGCGTCGGCTCCGTTGCGA<br>CGACCCTTCTTGCCGCTAAGGGCTATGAGGTAGCGGCA<br>GTGACTGGACGTGCGTCCGAAGCAGAATATCTGCGCG<br>GTTTGGGGGCGGCGAGCGTAATTGATCGTAACGAATTA<br>ACGGGGAAGGTACGCCCGCTGGGTCAGGAGCGTTGGG<br>CTGGCGGGATTGACGTGGCGGGATCAACCGTGCTTGCG<br>AACATGCTTTCTATGATGAAGTATCGCGGGGTAGTCGC<br>TGCGTGTGGCCTGGCCGCGGGCATGGATCTGCCCGCGT<br>CTGTCGCGCCCTTTATTCTTCGTGGGATGACGCTGGCA<br>GGGGTGGATAGCGTTATGTGCCCAAAGACAGATCGTTT<br>AGCAGCGTGGGCCCGTTTGGCGTCAGATCTTGACCCTG<br>CCAAGCTGGAGGAGATGACTACAGAGTTGCCGTTTAGT<br>GAAGTAATCGAGACAGCACCCAAATTCTTGGACGGGA<br>CGGTTCGTGGCCGCATTGTTATCCCCGTAACGCCCTAA<br>gaa*ctctagaaataattttgtttaacttta*a*gaaggagatatacat*ATGCGCAAA<br>GTGCCGATTATCACGGCTGACGAGGCCGCAAAACTGA<br>TCAAGGACGGCGACACCGTGACAACTAGCGGCTTTGT<br>GGGTAACGCGATCCCTGAGGCCCTTGACCGTGCAGTCG<br>AAAAGCGTTTCCTGGAAACGGGCGAACCGAAGAACAT<br>TACTTATGTATATTGCGGCAGTCAGGGCAATCGCGACG<br>GTCGTGGCGCAGAACATTTCGCGCATGAAGGCCTGCTG<br>AAACGTTATATCGCTGGCCATTGGGCGACCGTCCCGGC<br>GTTAGGGAAAATGGCCATGGAGAATAAAATGGAGGCC<br>TACAATGTCTCTCAGGGCGCCTTGTGTCATCTCTTTCGC<br>GATATTGCGAGCCATAAACCGGGTGTGTTCACGAAAGT<br>AGGAATCGGCACCTTCATTGATCCACGTAACGGTGGTG<br>GGAAGGTCAACGATATTACCAAGGAAGATATCGTAGA |

TABLE 59-continued of Exemplary Propionate Cassette Sequences

| Description and SEQ ID NO | Sequence |
|---|---|
| | ACTGGTGGAAATTAAAGGGCAGGAATACCTGTTTTATC<br>CGGCGTTCCCGATCCATGTCGCGCTGATTCGTGGCACC<br>TATGCGGACGAGAGTGGTAACATCACCTTTGAAAAAG<br>AGGTAGCGCCTTTGGAAGGGACTTCTGTCTGTCAAGCG<br>GTGAAGAACTCGGGTGGCATTGTCGTGGTTCAGGTTGA<br>GCGTGTCGTCAAAGCAGGCACGCTGGATCCGCGCCAT<br>GTGAAAGTTCCGGGTATCTATGTAGATTACGTAGTCGT<br>CGCGGATCCGGAGGACCATCAACAGTCCCTTGACTGCG<br>AATATGATCCTGCCCTTAGTGGAGAGCACCGTCGTCCG<br>GAGGTGGTGGGTGAACCACTGCCTTTATCCGCGAAGA<br>AAGTCATCGGCCGCCGTGGCGCGATTGAGCTCGAGAA<br>AGACGTTGCAGTGAACCTTGGGGTAGGTGCACCTGAGT<br>ATGTGGCCTCCGTGGCCGATGAAGAAGGCATTGTGGAT<br>TTTATGACTCTCACAGCGGAGTCCGGCGCTATCGGTGG<br>CGTTCCAGCCGGCGGTGTTCGCTTTGGGGCGAGCTACA<br>ATGCTGACGCCTTGATCGACCAGGGCTACCAATTTGAT<br>TATTACGACGGTGGGGGTCTGGATCTTTGTTACCTGGG<br>TTTAGCTGAATGCGACGAAAAGGGTAATATCAATGTTA<br>GCCGCTTCGGTCCTCGTATCGCTGGGTGCGGCGGATTC<br>ATTAACATTACCCAAAACACGCCGAAAGTCTTCTTTTG<br>TGGGACCTTTACAGCCGGGGGGCTGAAAGTGAAAATT<br>GAAGATGGTAAGGTGATTATCGTTCAGGAAGGGAAAC<br>AGAAGAAATTCCTTAAGGCAGTGGAGCAAATCACCTTT<br>AATGGAGACGTGGCCTTAGCGAACAAGCAACAAGTTA<br>CCTACATCACGGAGCGTTGCGTCTTCCTCCTCAAAGAA<br>GACGGTTTACACCTTTCGGAAATCGCGCCAGGCATCGA<br>TCTGCAGACCCAGATTTTGGATGTTATGGACTTTGCCC<br>CGATCATTGATCGTGACGCAAACGGGCAGATTAAACT<br>GATGGACGCGGCGTTATTCGCAGAAGGGCTGATGGGC<br>TTGAAAGAAATGAAGTCTTGAtaa*gaaggagatatacat*ATGAG<br>CTTAACCCAAGGCATGAAAGCTAAACAACTGTTAGCAT<br>ACTTTCAGGGTAAAGCCGATCAGGATGCACGTGAAGC<br>GAAAGCCCGCGGTGAGCTGGTCTGCTGGTCGGCGTCA<br>GTCGCGCCGCCGGAATTTTGCGTAACAATGGGCATTGC<br>CATGATCTACCCGGAGACTCATGCAGCGGGCATCGGTG<br>CCCGCAAAGGTGCGATGGACATGCTGGAAGTTGCGGA<br>CCGCAAAGGCTACAACGTGGATTGTTGTTCCTACGGCC<br>GTGTAAATATGGGTTACATGGAATGTTTAAAAGAAGCC<br>GCCATCACGGGCGTCAAGCCGGAAGTTTTGGTTAATTC<br>CCCTGCTGCTGACGTTCCGCTTCCCGATTTGGTGATTAC<br>GTGTAATAATATCTGTAACACGCTGCTGAAATGGTACG<br>AAAACTTAGCAGCAGAACTCGATATTCCTTGCATCGTG<br>ATCGACGTACCGTTTAATCATACCATGCCGATTCCGGA<br>ATATGCCAAGGCCTACATCGCGGACCAGTTCCGCAATG<br>CAATTTCTCAGCTGGAAGTTATTTGTGGCCGTCCGTTC<br>GATTGGAAGAAATTTAAGGAGGTCAAAGATCAGACCC<br>AGCGTAGCGTATACCACTGGAACCGCATTGCCGAGAT<br>GGCGAAATACAAGCCTAGCCCGCTGAACGGCTTCGAT<br>CTGTTCAATTACATGGCGTTAATCGTGGCGTGCCGCAG<br>CCTGGATTATGCAGAAATTACCTTTAAAGCGTTCGCGG<br>ACGAATTAGAAGAGAATTTGAAGGCGGGTATCTACGC<br>CTTTAAAGGTGCGGAAAAAACGCGCTTTCAATGGGAA<br>GGTATCGCGGTGTGGCCACATTTAGGTCACACGTTTAA<br>ATCTATGAAGAATCTGAATTCGATTATGACCGGTACGG<br>CATACCCCGCCCTTTGGGACCTGCACTATGACGCTAAC<br>GACGAATCTATGCACTCTATGGCTGAAGCGTACACCCG<br>TATTTATATTAATACTTGTCTGCAGAACAAAGTAGAGG<br>TCCTGCTTGGGATCATGGAAAAAGGCCAGGTGGATGG<br>TACCGTATATCATCTGAATCGCAGCTGCAAACTGATGA<br>GTTTCCTGAACGTGGAAACGGCTGAAATTATTAAAGAG<br>AAGAACGGTCTTCCTTACGTCTCCATTGATGGCGATCA<br>GACCGATCCTCGCGTTTTTCTCCGGCCCAGTTTGATAC<br>CCGTGTTCAGGCCCTGGTTGAGATGATGGAGGCCAATA<br>TGGCGGCAGCGGAATAAtaa*gaaggagatatacat*ATGTCACGC<br>GTGGAGGCAATCCTGTCGCAGCTGAAAGATGTCGCCG<br>CGAATCCGAAAAAAGCCATGGATGACTATAAAGCTGA<br>AACAGGTAAGGGCGCGGTTGGTATCATGCCGATCTAC<br>AGCCCCGAAGAAATGGTACACGCCGCTGGCTATTTGCC<br>GATGGGAATCTGGGCGCCCAGGGCAAAACGATTAGT<br>AAAGCGCGCACCTATCTGCCTGCTTTTGCCTGCAGCGT<br>AATGCAGCAGGTTATGGAATTACAGTGCGAGGGCGCG<br>TATGATGACCTGTCCGCAGTTATTTTTAGCGTACCGTG<br>CGACACTCTCAAATGTCTTAGCCAGAAATGGAAAGGT<br>ACGTCCCCAGTGATTGTATTTACGCATCCGCAGAACCG<br>CGGATTAGAAGCGGCGAACCAATTCTTGGTTACCGAGT |

TABLE 59-continued of Exemplary Propionate Cassette Sequences

| Description and SEQ ID NO | Sequence |
|---|---|
| | ATGAACTGGTAAAAGCACAACTGGAATCAGTTCTGGG<br>TGTGAAAATTTCAAACGCCGCCCTGGAAAATTCGATTG<br>CAATTTATAACGAGAATCGTGCCGTGATGCGTGAGTTC<br>GTGAAAGTGGCAGCGGACTATCCTCAAGTCATTGACGC<br>AGTGAGCCGCCACGCGGTTTTTAAAGCGCGCCAGTTTA<br>TGCTTAAGGAAAAACATACCGCACTTGTGAAAGAACT<br>GATCGCTGAGATTAAAGCAACGCCAGTCCAGCCGTGG<br>GACGGAAAAAAGGTTGTAGTGACGGGCATTCTGTTGG<br>AACCGAATGAGTTATTAGATATCTTTAATGAGTTTAAG<br>ATCGCGATTGTTGATGATGATTTAGCGCAGGAAAGCCG<br>TCGGATCCGTGTTGACGTTCTGGACGGAGAAGGCGGA<br>CCGCTCTACCGTATGGCTAAAGCGTGGCAGCAAATGTA<br>TGGCTGCTCGCTGGCAACCGACACCAAGAAGGGTCGC<br>GGCCGTATGTTAATTAACAAAACGATTCAGACCGGTGC<br>GGACGCTATCGTAGTTGCAATGATGAAGTTTTGCGACC<br>CAGAAGAATGGGATTATCCGGTAATGTACCGTGAATTT<br>GAAGAAAAAGGGGTCAAATCACTTATGATTGAGGTGG<br>ATCAGGAAGTATCGTCTTTCGAACAGATTAAAACCCGT<br>CTGCAGTCATTCGTCGAAATGCTTTAAtaa*gaaggagatataca*<br>t*ATGTATACCTTGGGGATTGATGTCGGTTCTGCCTCTAG<br>TAAAGCGGTGATTCTGAAAGATGGAAAAGATATTGTC<br>GCTGCCGAGGTTGTCCAAGTCGGTACCGGCTCCTGGG<br>TCCCCAACGCGCACTGGACAAAGCCTTTGAAGTCTCTG<br>GCTTAAAAAAGGAAGACATCAGCTACACAGTAGCTAC<br>GGGCTATGGGCGCTTCAATTTTAGCGACGCGGATAAAC<br>AGATTTCGGAAATTAGCTGTCATGCCAAAGGCATTTAT<br>TTCTTAGTACCAACTGCGCGCACTATTATTGACATTGG<br>CGGCCAAGATGCGAAAGCCATCCGCCTGGACGACAAG<br>GGGGGTATTAAGCAATTCTTCATGAATGATAAATGCGC<br>GGCGGGCACGGGGCGTTTCCTGGAAGTCATGGCTCGC<br>GTACTTGAAACCACCCTGGATGAAATGGCTGAACTGG<br>ATGAACAGGCGACTGACACCGCTCCCATTTCAAGCACC<br>TGCACGGTTTTCGCCGAAAGCGAAGTAATTAGCCAATT<br>GAGCAATGGTGTCTCACGCAACAACATCATTAAAGGT<br>GTCCATCTGAGCGTTGCGTCACGTGCGTGTGGTCTGGC<br>GTATCGCGGCGGTTTGGAGAAAGATGTTGTTATGACAG<br>GTGGCGTGGCAAAAAATGCAGGGGTGGTGCGCGCGGT<br>GGCGGGCGTTCTGAAGACCGATGTTATCGTTGCTCCGA<br>ATCCTCAGACGACCGGTGCACTGGGGGCAGCGCTGTAT<br>GCTTATGAGGCCGCCCAGAAGAAGTA |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 185, 186, 187, or 188, or a functional fragment thereof.

Example 25

Quantification of Propionate by LC-MS/MS

Sample Preparation

First, fresh 1000, 500, 250, 100, 20, 4 and 0.8 μg/mL sodium propionate standards were prepared in water. Then, 25 μL of sample (bacterial supernatants and standards) were pipetted into a V-bottom polypropylene 96-well plate, and 75 μL of 60% ACN (45 uL ACN+30 uL water per reaction) with 10 ug/mL of butyrate-d5 (CDN isotope) internal standard in final solution were added to each sample. The plate was heat-sealed, mixed well, and centrifuged at 4000 rpm for 5 minutes. In a round-bottom 96-well polypropylene plate, 5 μL of diluted samples were added to 95 μL of a buffer containing 10 mM MES pH4.5, 20 mM EDC (N-(3-Dimethylaminopropyl)-N'-ethylcarbodiimide), and 20 mM TFEA (2,2,2-trifluroethylamine). The plate was again heat-sealed and mixed well, and samples were incubated at room temperature for 1 hour LC-MS/MS Method Propionate was measured by liquid chromatography coupled to tandem mass spectrometry (LC-MS/MS) using a Thermo TSQ Quantum Max triple quadrupole mass spectrometer. HPLC Details are listed in Table 60 and Table 61. Tandem Mass Spectrometry details are found in Table 62.

TABLE 60

| HPLC Details | |
|---|---|
| Column | Thermo Aquasil C18 column, 5 μm (50 × 2.1 mm) |
| Mobile Phase A | 100% H2O, 0.1% Formic Acid |
| Mobile Phase B | 100% ACN, 0.1% Formic Acid |
| Injection volume | 10 uL |

TABLE 61

HPLC Method

| Total Time (min) | Flow Rate (µL/min) | A % | B % |
|---|---|---|---|
| 0 | 0.5 | 100 | 0 |
| 1 | 0.5 | 100 | 0 |
| 2 | 0.5 | 10 | 90 |
| 4 | 0.5 | 10 | 90 |
| 4.01 | 0.5 | 100 | 0 |
| 4.25 | 0.5 | 100 | 0 |

TABLE 62

Tandem Mass Spectrometry Details

| | |
|---|---|
| Ion Source | HESI-II |
| Polarity | Positive |
| SRM transitions | Propionate 156.2/57.1, Propionate-d5 161/62.1 |

Example 26

Generation of Constructs for Overproducing Therapeutic Molecules for Secretion

To produce strain capable of secreting anti-inflammatory or gut barrier enhancer polypeptides, e.g., GLP2, IL-22, IL-10 (viral or human), several constructs are designed employing different secretion strategies. The organization of exemplary constructs is shown in FIG. 30A, FIG. 30B, FIG. 30C, and FIG. 31A and FIG. 31B, FIG. 32A, FIG. 32B, FIG. 32C, FIG. 32D, FIG. 32E. Various GLP2, IL-22, IL-10 (viral or human) constructs are synthesized, and cloned into vector pBR322 for transformation of E. coli. In some embodiments, the constructs encoding the effector molecules are integrated into the genome. In some embodiments, the constructs encoding the effector molecules are on a plasmid, e.g., a medium copy plasmid. Table 63. lists exemplary polypeptide coding sequences used in the constructs.

TABLE 63

Polypeptide coding sequences

| Description | Sequence | SEQ ID NO |
|---|---|---|
| GLP2 | CATGCTGATGGTTCTTTCTCTGATGAGAT GAACACCATTCTTGATAATCTTGCCGCCA GGGACTTTATAAACTGGTTGATTCAGACC AAAATCACTGAC | SEQ ID NO: 189 |
| GLP2 codon optimized | CATGCTGACGGCTCTTTTTCTGACGAAAT GAATACCATCCTGGATAATCTGGCGGCG CGTGATTTTATTAATTGGCTGATCCAAAC TAAAATTACTGATTAA | SEQ ID NO: 190 |
| FliC20-GLP2 (FliC20, start of FliC gene preceding GLP2 sequence underlined) | <u>ATGGCACAAGTCATTAATACCAACAGCC TCTCGCTGATCACTCAAAATAATATCAAC AAG</u>CATGCTGACGGCTCTTTTTCTGACGA AATGAATACCATCCTGGATAATCTGGCG GCGCGTGATTTTATTAATTGGCTGATCCA AACTAAAATTACTGATTAA | SEQ ID NO: 191 |
| GLP2 codon optimized (e.g., used in fliC construct) | ATGCATGCTGACGGCTCTTTTTCTGACGA AATGAATACCATCCTGGATAATCTGGCG GCGCGTGATTTTATTAATTGGCTGATCCA AACTAAAATTACTGATTAA | SEQ ID NO: 192 |
| vIL10 codon optimized (e.g., used in fliC construct) | ATGGGTACTGACCAATGTGATAATTTCCC ACAAATGCTGCGTGATTTGCGCGACGCTT TCTCGCGTGTGAAAACTTTTTTTCAGACT AAAGATGAGGTGGATAATCTGCTGCTGA AAGAGAGCCTGTTGGAAGATTTTAAAGG CTACTTGGGCTGTCAAGCGCTGTCGGAG ATGATTCAATTTTATCTGGAAGAGGTGAT GCCGCAAGCTGAGAACCAAGATCCGGAA GCGAAAGATCACGTGAATTCGCTGGGCG AGAATCTGAAAACTCTGCGTCTGCGTCTG CGTCGTTGTCACCGTTTTTTGCCGTGCGA AAACAAAAGTAAAGCTGTTGAGCAAATT AAAAACGCTTTTAACAAACTGCAGGAAA AAGGTATCTATAAAGCGATGAGCGAATT TGATATTTTTATTAATTATATTGAAGCTT ATATGACTATTAAAGCTCGCTAA | SEQ ID NO: 193 |
| vIL10 | GGTACAGACCAATGTGACAATTTTCCCCA AATGTTGAGGGACCTAAGAGATGCCTTC AGTCGTGTTAAAACCTTTTTCCAGACAAA GGACGAGGTAGATAACCTTTTGCTCAAG GAGTCTCTGCTAGAGGACTTTAAGGGCT ACCTTGGATGCCAGGCCCTGTCAGAAAT | SEQ ID NO: 194 |

TABLE 63-continued

Polypeptide coding sequences

| Description | Sequence | SEQ ID NO |
|---|---|---|
| | GATCCAATTCTACCTGGAGGAAGTCATG<br>CCACAGGCTGAAAACCAGGACCCTGAAG<br>CCAAAGACCATGTCAATTCTTTGGGTGAA<br>AATCTAAAGACCCTACGGCTCCGCCTGC<br>GCCGTTGCCACAGGTTCCTGCCGTGTGAG<br>AACAAGAGTAAAGCTGTGGAACAGATAA<br>AAAATGCCTTTAACAAGCTGCAGGAAAA<br>AGGAATTTACAAAGCCATGAGTGAATTT<br>GACATTTTTATTAACTACATAGAAGCATA<br>CATGACAATTAAAGCCAGG | |
| IL-22 codon optimized (e.g., use with diffusible outer membrane construct) | GCACCGATCTCTTCCCACTGTCGCTTAGA<br>TAAATCGAATTTTCAACAACCTTATATTA<br>CGAATCGTACGTTTATGCTGGCTAAAGA<br>AGCGTCATTAGCTGATAACAACACTGAT<br>GTTCGCCTGATTGGTGAGAAATTGTTTCA<br>CGGTGTGTCTATGTCAGAACGTTGCTACC<br>TGATGAAACAAGTTCTGAATTTCACCCTG<br>GAAGAAGTGTTGTTTCCGCAATCTGACCG<br>CTTTCAACCGTATATGCAAGAGGTTGTGC<br>CGTTTCTGGCGCGCCTGAGTAATCGCCTG<br>AGCACTTGTCATATTGAGGGCGACGACC<br>TGCATATTCAACGAAATGTTCAAAAATTG<br>AAAGATACGGTGAAGAAACTGGGTGAAA<br>GTGGTGAAATCAAAGCGATTGGTGAGCT<br>GGATCTGCTGTTTATGTCATTGCGCAATG<br>CGTGCATTTAA | SEQ ID NO: 195 |
| IL-22 codon optimized (e.g., used in fliC construct) | ATGGCACCGATCTCTTCCCACTGTCGCTT<br>AGATAAATCGAATTTTCAACAACCTTATA<br>TTACGAATCGTACGTTTATGCTGGCTAAA<br>GAAGCGTCATTAGCTGATAACAACACTG<br>ATGTTCGCCTGATTGGTGAGAAATTGTTT<br>CACGGTGTGTCTATGTCAGAACGTTGCTA<br>CCTGATGAAACAAGTTCTGAATTTCACCC<br>TGGAAGAAGTGTTGTTTCCGCAATCTGAC<br>CGCTTTCAACCGTATATGCAAGAGGTTGT<br>GCCGTTTCTGGCGCGCCTGAGTAATCGCC<br>TGAGCACTTGTCATATTGAGGGCGACGA<br>CCTGCATATTCAACGAAATGTTCAAAAAT<br>TGAAAGATACGGTGAAGAAACTGGGTGA<br>AAGTGGTGAAATCAAAGCGATTGGTGAG<br>CTGGATCTGCTGTTTATGTCATTGCGCAA<br>TGCGTGCATTTAA | SEQ ID NO: 196 |
| hIL-10 codon optimized | TCGCCAGGTCAAGGAACGCAGTCAGAGA<br>ATTCATGCACTCACTTTCCGGGCAATCTG<br>CCGAATATGCTGCGCGATCTGCGAGATG<br>CATTCTCTCGCGTGAAAACGTTCTTTCAA<br>ATGAAAGATCAACTGGATAATCTGCTGC<br>TGAAGGAGTCGTTGTTGGAGGATTTTAA<br>GGGGTATCTGGGTTGTCAAGCACTGTCTG<br>AAATGATTCAATTTTACTTGGAGGAAGTT<br>ATGCCGCAAGCGGAAAACCAAGATCCGG<br>ATATTAAGGCGCACGTGAACTCACTGGG<br>CGAAAACCTGAAAACTTTGCGCCTGCGT<br>CTGAGACGATGTCACCGATTCCTGCCGTG<br>TGAAAACAAGTCAAAGGCGGTTGAGCAA<br>GTTAAGAATGCTTTCAATAAGCTGCAAG<br>AAAAGGGCATCTATAAAGCGATGTCTGA<br>ATTTGATATCTTTATAAACTACATAGAAG<br>CTTATATGACTATGAAGATTCGAAATTAA | SEQ ID NO: 197 |
| Monomerized hIL-10 (codon opt) | TCGCCAGGTCAAGGAACGCAGTCAGAGA<br>ATTCATGCACTCACTTTCCGGGCAATCTG<br>CCGAATATGCTGCGCGATCTGCGAGATG<br>CATTCTCTCGCGTGAAAACGTTCTTTCAA<br>ATGAAAGATCAACTGGATAATCTGCTGC<br>TGAAGGAGTCGTTGTTGGAGGATTTTAA<br>GGGGTATCTGGGTTGTCAAGCACTGTCTG<br>AAATGATTCAATTTTACTTGGAGGAAGTT<br>ATGCCGCAAGCGGAAAACCAAGATCCGG<br>ATATTAAGGCGCACGTGAACTCACTGGG<br>CGAAAACCTGAAAACTTTGCGCCTGCGT<br>CTGAGACGATGTCACCGATTCCTGCCGTG<br>TGAAAACGGAGGAGGAAGTGGTGGTAAG | SEQ ID NO: 198 |

TABLE 63-continued

| Polypeptide coding sequences | | |
|---|---|---|
| Description | Sequence | SEQ ID NO |
| | TCAAAGGCGGTTGAGCAAGTTAAGAATG CTTTCAATAAGCTGCAAGAAAAGGGCAT CTATAAAGCGATGTCTGAATTTGATATCT TTATAAACTACATAGAAGCTTATATGACT ATGAAGATTCGAAATTAA | |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 189, SEQ ID NO: 190, SEQ ID NO: 191, SEQ ID NO: 192, SEQ ID NO: 193, SEQ ID NO: 194, SE ID NO: 195, SE ID NO: 196, SEQ ID NO: 197, or SEQ ID NO: 198 or a functional fragment thereof.

Table 64 lists exemplary secretion tags, which can be added at the N-terminus when the diffusible outer membrane (DOM) method or the fliC method is used.

TABLE 64

Figure 30A:
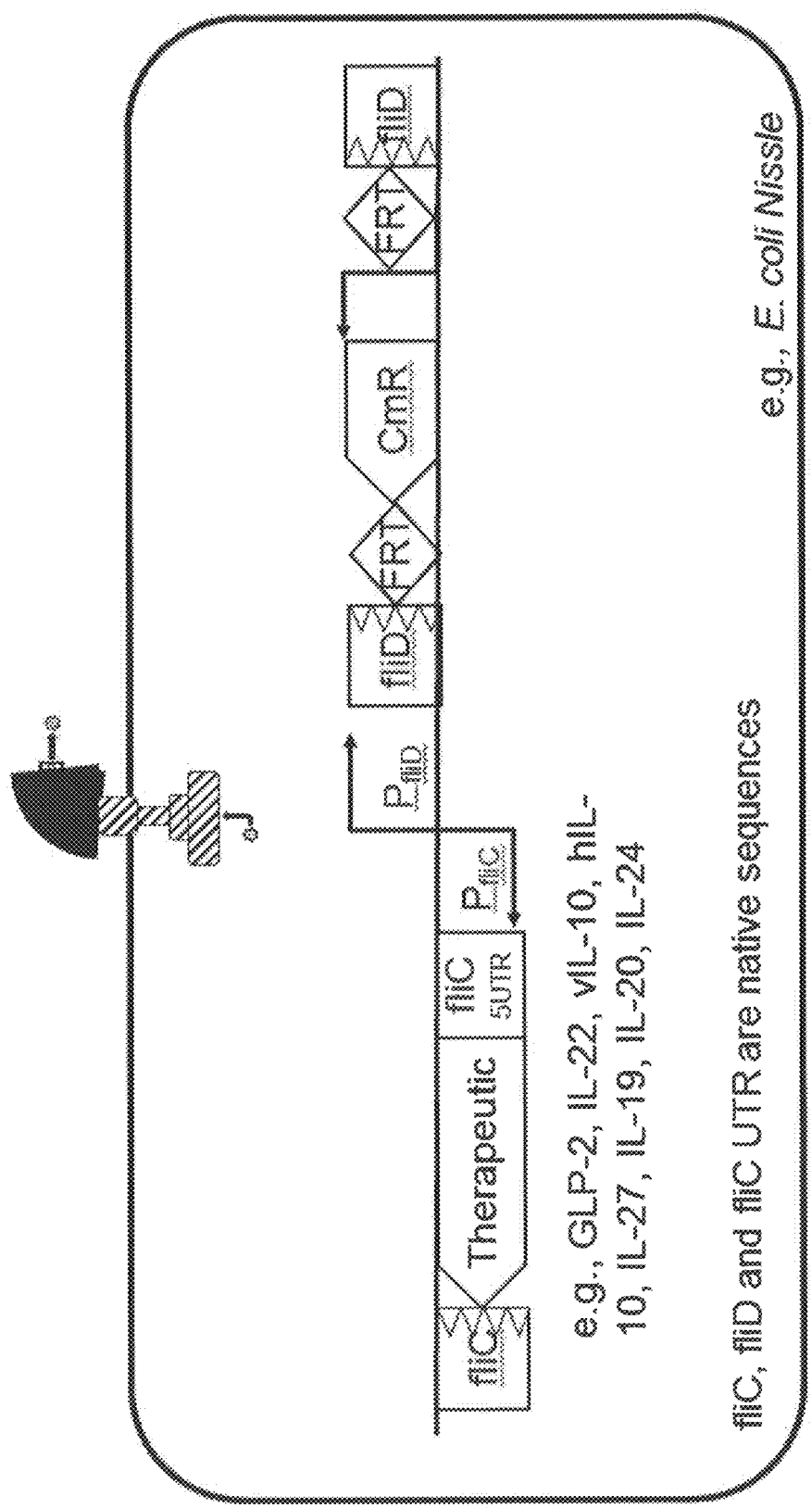
FIG. 30A, FIG. 30B, and FIG. 30C depict schematics of the gene organization of exemplary circuits of the disclosure for the expression of therapeutic polypeptides, which are secreted using components of the flagellar type III secretion system. A therapeutic polypeptide of interest, such as, GLP-2, IL-10, and IL-22, is assembled behind a fliC-5'UTR, and is driven by the native fliC and/or fliD promoter (FIG. 30A and FIG. 30B) or a tet-inducible promoter (FIG. 30C). In alternate embodiments, an inducible promoter such as oxygen level-dependent promoters (e.g., FNR-inducible promoter), promoters induced by IBD specific molecules or promoters induced by inflammation or an inflammatory response (RNS, ROS promoters), and promoters induced by a metabolite that may or may not be naturally present (e.g., can be exogenously added) in the gut, e.g., arabinose can be used. The therapeutic polypeptide of interest is either expressed from a plasmid (e.g., a medium copy plasmid) or integrated into fliC loci (thereby deleting all or a portion of fliC and/or fliD). Optionally, an N terminal part of FliC is included in the construct, as shown in FIG. 30B and FIG. 30D.
Figure 30B:
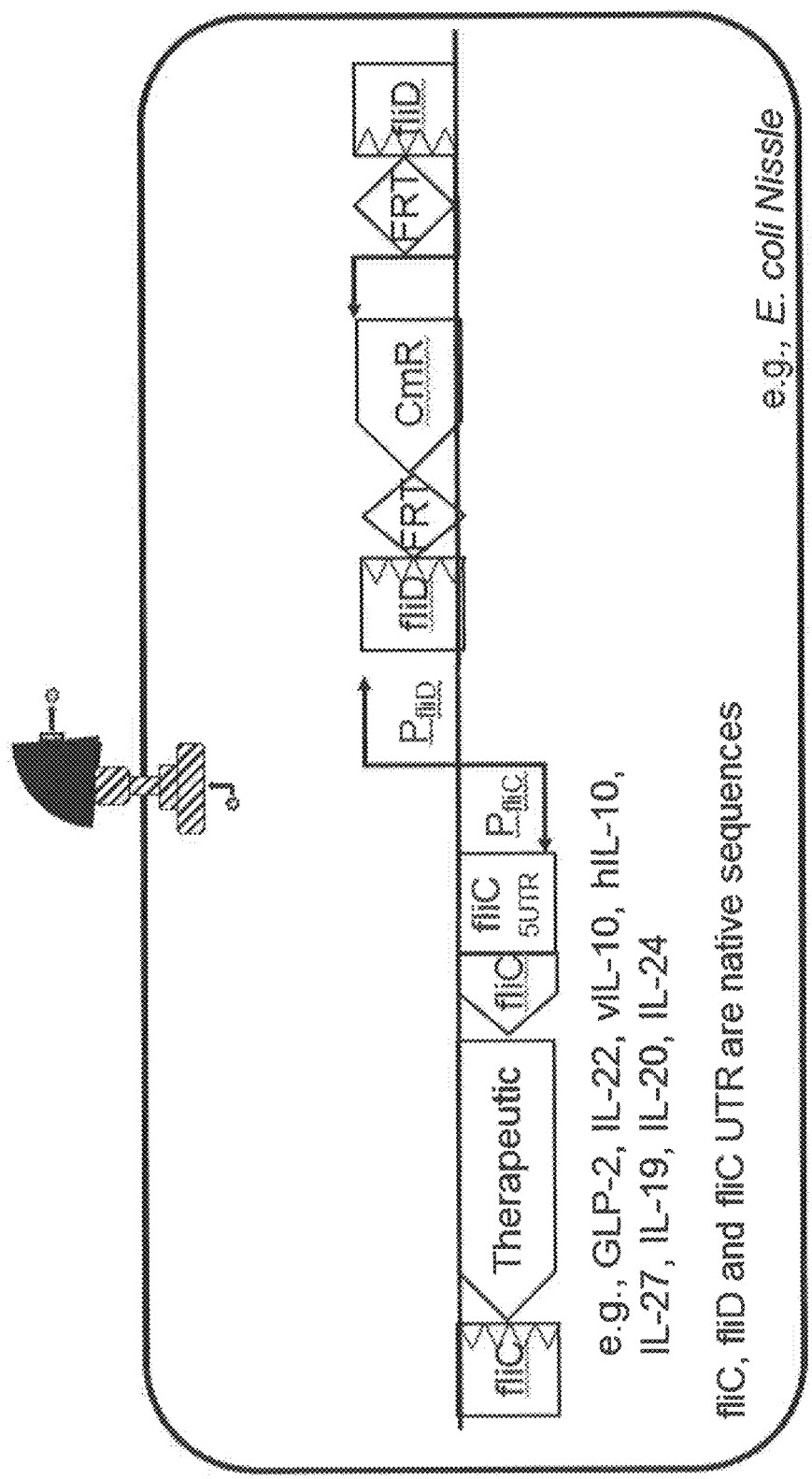
Figure 30C:
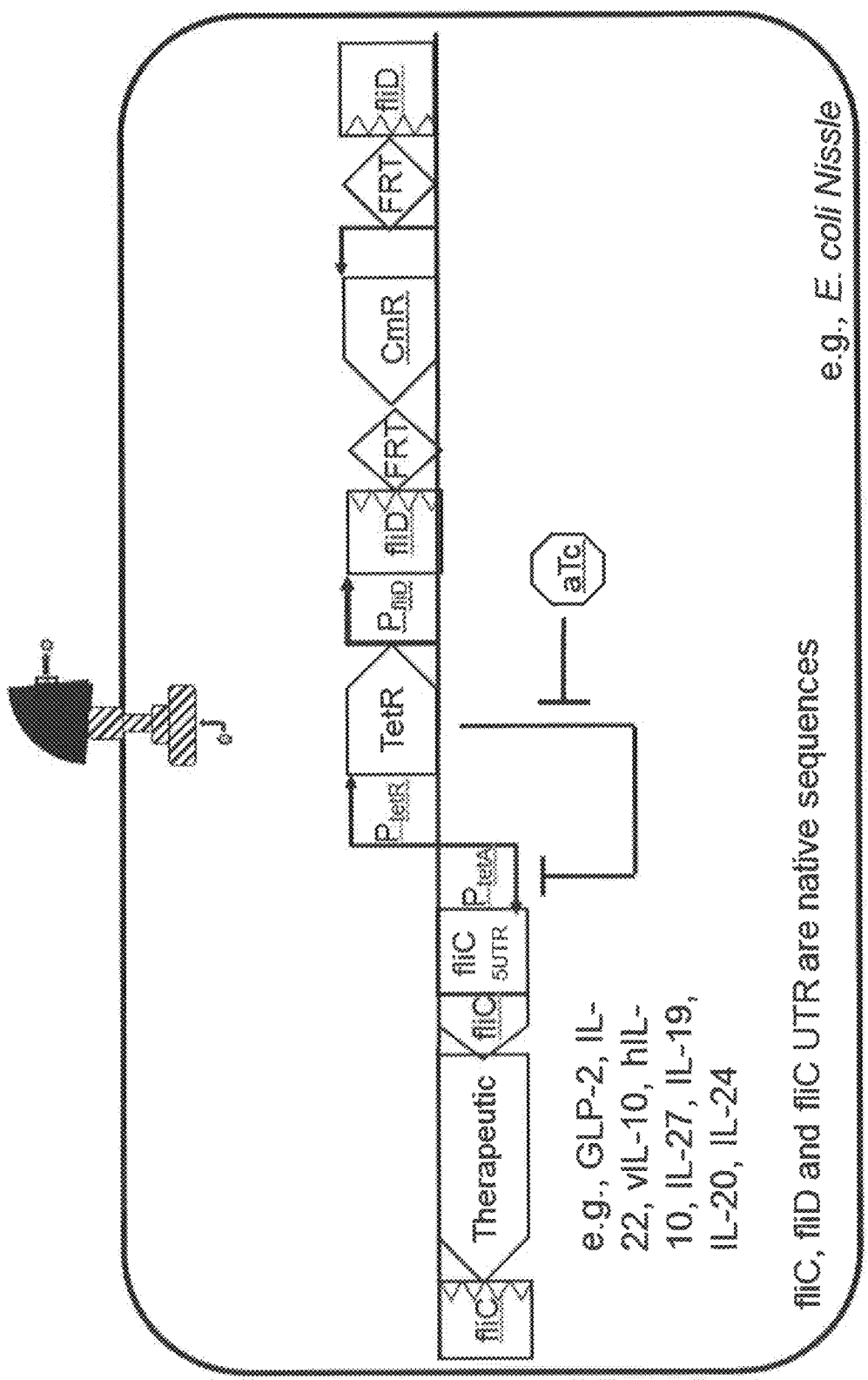
Figure 31A:
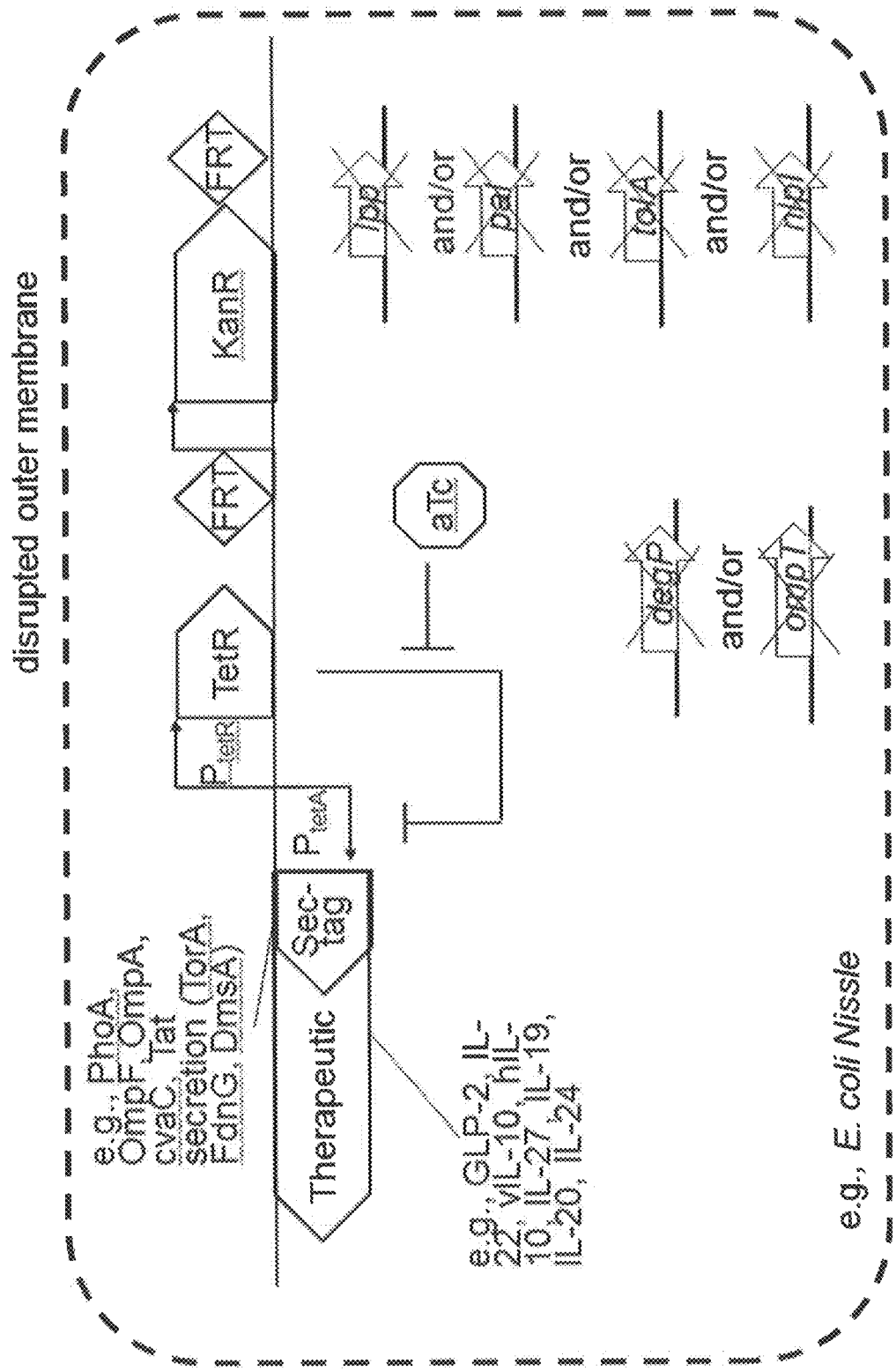
FIG. 31A and FIG. 31B depict schematics of the gene organization of exemplary circuits of the disclosure for the expression of therapeutic polypeptides, which are secreted via a diffusible outer membrane (DOM) system. The therapeutic polypeptide of interest is fused to a prototypical N-terminal Sec-dependent secretion signal or Tat-dependent secretion signal, which is cleaved upon secretion into the periplasmic space. Exemplary secretion tags include sec-dependent PhoA, OmpF, OmpA, cvaC, and Tat-dependent tags (TorA, FdnG, DmsA). In certain embodiments, the genetically engineered bacteria comprise deletions in one or more of lpp, pal, tolA, and/or nlpI. Optionally, periplasmic proteases are also deleted, including, but not limited to, degP and ompT, e.g., to increase stability of the polypeptide in the periplasm. A FRT-KanR-FRT cassette is used for downstream integration. Expression is driven by a tet promoter (FIG. 31A) or an inducible promoter, such as oxygen level-dependent promoters (e.g., FNR-inducible promoter, FIG. 31B), promoters induced by IBD specific molecules or promoters induced by inflammation or an inflammatory response (RNS, ROS promoters), and promoters induced by a metabolite that may or may not be naturally present (e.g., can be exogenously added) in the gut, e.g., arabinose.
Figure 31B:
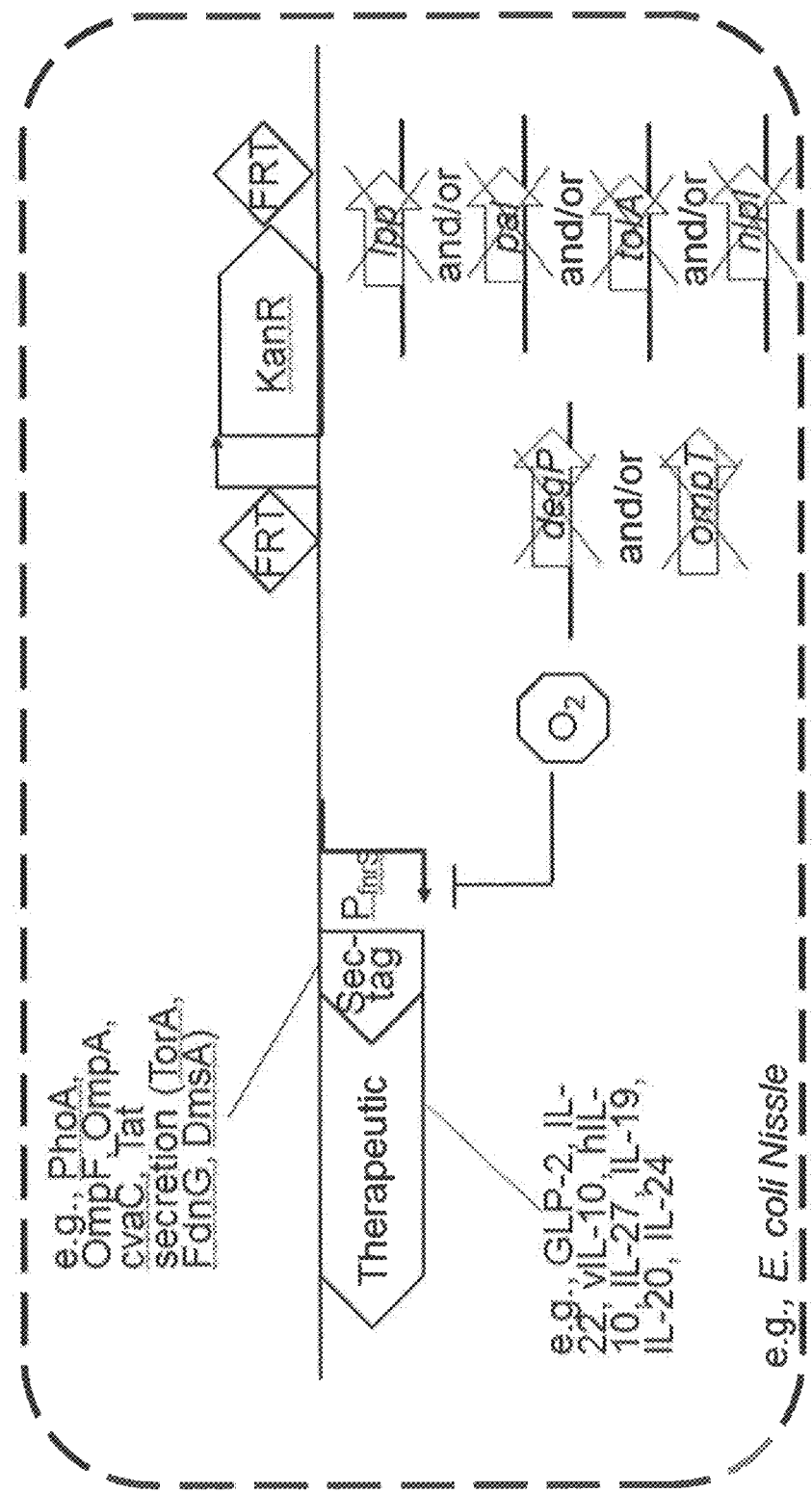

| Secretion Tags and FliC components | | |
|---|---|---|
| Sequence Name | Sequence | SEQ ID NO |
| fliC-FliC20 (e.g., used in GLP2 construct) FliC20: start of the fliC gene which (in some constructs) precedes the effector polypeptide sequence, see e.g., FIG. 30B and FIG. 30C shown in italics fliC: native fliC UTR in bold, optimized RBS underlined | tgacggcgattgagccgacgggtggaaaccc aaaacgtaatcaac<u>GTGGGTACTC CTTAAATTGGGTTCGAATGG ACC</u>*atggcacaagtcattaataccaacagc ctctcgctgatcactcaaaataatatcaacaag* | SEQ ID NO: 199 |
| fliC-RBS (e.g., used in IL22 construct) fliC: native fliC UTR in bold, optimized RBS underlined | tgacggcgattgagccgacgggtggaaaccc aaaacgtaatcaac<u>tacgaacacttcagga ggtaccca</u> | SEQ ID NO: 200 |
| fliC-RBS (e.g., used in GLP2 construct) fliC: native fliC UTR in bold, optimized RBS underlined | tgacggcgattgagccgacgggtggaaaccc aaaacgtaatcaac<u>aagtataaactctggga ggttccta</u> | |
| fliC-RBS (e.g., used in vIL10 construct) fliC: native fliC UTR in bold, optimized RBS underlined | tgacggcgattgagccgacgggtggaaaccc aaaacgtaatcaac<u>tcaaatcccttaataagg aggtaaa</u> | SEQ ID NO: 201 |
| RBS-phoA RBS: underlined | <u>Ctctagaaataatttgtttaactttaagaaggaga tatacat</u>atgaaacaaagcactattgcactggca ctcttaccgttactgtttacccctgtgacaaaagcg | SEQ ID NO: 202 |
| phoA | atgaaacaaagcactattgcactggcactcttac cgttactgtttacccctgtgacaaaagcg | SEQ ID NO: 203 |
| RBS-ompF RBS: underlined | <u>Ctctagaaataatttgtttaactttaagaaggaga tatacat</u>atgatgaagcgcaatattctggcagtga tcgtccctgctctgttagtagcaggtactgcaaac gct | SEQ ID NO: 204 |
| ompF | atgatgaagcgcaatattctggcagtgatcgtcc ctgctctgttagtagcaggtactgcaaacgct | SEQ ID NO: 205 |
| RBS-cvaC RBS: underlined | <u>Ctctagaaataatttgtttaactttaagaaggaga tatacat</u>ATGAGAACTCTGACTCT AAATGAATTAGATTCTGTTTC TGGTGGT | SEQ ID NO: 206 |
| cvaC | ATGAGAACTCTGACTCTAAAT GAATTAGATTCTGTTTCTGGT GGT | SEQ ID NO: 207 |

TABLE 64-continued

Secretion Tags and FliC components

| Sequence Name | Sequence | SEQ ID NO |
|---|---|---|
| RBS-phoA (Opimized, e.g., used in IL10 construct) RBS: underlined | <u>GACGCCAGAGAGTTAAGGGG GTTAAATGAAACAATCGACC</u> ATCGCATTGGCGCTGCTTCCT CTATTGTTCACACCGGTGACA AAGGCA | SEQ ID NO: 208 |
| Optimized phoA | ATGAAACAATCGACCATCGC ATTGGCGCTGCTTCCTCTATT GTTCACACCGGTGACAAAGG CA | SEQ ID NO: 209 |
| RBS-TorA RBS: underlined | <u>ctctagaaataattttgtttaactttaagaaggagat atacat</u>ATGAACAATAACGATCT CTTTCAGGCATCACGTCGGCG TTTTCTGGCACAACTCGGCGG CTTAACCGTCGCCGGGATGCT GGGGCCGTCATTGTTAACGCC GCGACGTGCGACTGCG | SEQ ID NO: 210 |
| TorA | ATGAACAATAACGATCTCTTT CAGGCATCACGTCGGCGTTTT CTGGCACAACTCGGCGGCTTA ACCGTCGCCGGGATGCTGGG GCCGTCATTGTTAACGCCGCG ACGTGCGACTGCG | SEQ ID NO: 211 |
| RBS-TorA alternate | <u>CCCACATTCGAGGTACTAA</u>atg aacaataacgatctctttcaggcatcacgtcggc gttttctggcacaactcggcggcttaaccgtcgc cgggatgctggggacgtcattgttaacgccgcg ccgtgcgactgcggcgcaagcggcg | SEQ ID NO: 212 |
| TorA (alternate) | atgaacaataacgatctctttcaggcatcacgtcg gcgttttctggcacaactcggcggcttaaccgtc gccgggatgctggggacgtcattgttaacgccg cgccgtgcgactgcggcgcaagcggcg | SEQ ID NO: 213 |
| RBS-fdnG | ACCCTATTACACACCTAAGGA GGCCAAATACatggacgtcagtcgcag acaattttttaaaatctgcgcgggcggtatggcg ggaacaacagtagcagcattgggctttgccccg aagcaagcactggct | SEQ ID NO: 214 |
| fdnG | atggacgtcagtcgcagacaattttttaaaatctg cgcgggcggtatggcgggaacaacagtagca gcattgggctttgccccgaagcaagcactggct | SEQ ID NO: 215 |
| RBS-dmsA | TACGCAAAAAACATAATTTAA GAGAGGATAAACatgaaaacgaaaa tccctgatgcggtattggctgctgaggtgagtcg ccgtggtttggtaaaaacgacagcgatcggcgg cctggcaatggccagcagcgcattaacattacct tttagtcggattgcgcacgct | SEQ ID NO: 216 |
| dmsA | atgaaaacgaaaatccctgatgcggtattggctg ctgaggtgagtcgccgtggtttggtaaaaacgac agcgatcggcggcctggcaatggccagcagcg cattaacattacctttagtcggattgcgcacgct | SEQ ID NO: 217 |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 199, SEQ ID NO: 200, SEQ ID NO: 291, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO 209. SEQ ID NO: 210, SEQ ID NO: 211,SEQ ID NO: 212, SEQ ID NO: 213, SEQ ID NO: 214, SEQ ID NO: 215, SEQ ID NO: 216, and SEQ ID NO: 217. Table 65 lists exemplary promoter sequences and miscellaneous construct sequences.

TABLE 65

Promoter Sequences and Miscellaneous Construct Sequences

| Description | Sequence | SEQ ID NO |
|---|---|---|
| TetR/TetA Promoter | gaattcgttaagacccactttcacatttaagttgttttctaatccgcatatgatcaattcaag gccgaataagaaggctggctctgcaccttggtgatcaaataattcgatagcttgtcgtaata atggcggcatactatcagtagtaggtgtttcccttcttctttagcgacttgatgctcttgatc ttccaatacgcaacctaaagtaaaatgccccacagcgctgagtgcatataatgcattctct agtgaaaaaccttgttggcataaaaaggctaattgattttcgagagtttcatactgttttct gtaggccgtgtacctaaatgtacttttgctccatcgcgatgacttagtaaagcacatctaaa acttttagcgttattacgtaaaaaatcttgccagctttcccttctaaagggcaaaagtgag tatggtgcctatctaacatctcaatggctaaggcgtcgagcaaagcccgcttattttttacat gccaatacaatgtaggctgctctacacctagcttctgggcgagtttacgggttgttaaaccttt cgattccgacctcattaagcagctctaatgcgctgttaatcactttacttttatctaatctaga catcattaattcctaattttgttgacactctatcattgatagagttattttaccactccctatc agtgatagagaaaagtgaa | SEQ ID NO: 218 |
| fliC Promoter | agcgggaataaggggcagagaaaagagtatttcgtcgactaacaaaaaatggctgtttgt gaaaaaaattctaaaggttgttttacgacagacgataacagggt | SEQ ID NO: 219 |
| FnrS Promoter | ggtaccAGTTGTTCTTATTGGTGGTGTTGCTTTATGGTTGCATCGTAGT AAATGGTTGTAACAAAAGCAATTTTTCCGGCTGTCTGTATACAAAAA CGCCGCAAAGTTTGAGCGAAGTCAATAAACTCTCTACCCATTCAGGG CAATATCTCTCTTggatcc | SEQ ID NO: 220 |
| DOM Construct Terminator | cacatttccccgaaaagtgccgatggccccccgatggtagtgtggcccatgcgagagtagg gaactgccaggcatcaaataaaacgaaaggctcagtcgaaagactgggcctttcgttttat ctgttgtttgtcggtgaacgctctcctgagtaggacaaatccgccgggagcggatttgaacg ttgcgaagcaacgcccgagggtggcgggcaggacgcccgccataaactgccaggcat caaattaagcagaaggccatcctgacggatggccttttttgcgtggccagtgccaagcttgc atgcagattgcagcattacacgtcttgagcgattgtgtaggctggagctgcttc | SEQ ID NO: 221 |
| FRT Site | gaagttcctatactttctagagaataggaacttcggaataggaacttc | SEQ ID NO: 222 |
| Kanamycin Resistance Cassette (for integration in between FRT sites) | aagatcccctcacgctgccgcaagcactcagggcgcaagggctgctaaaggaagcggaa cacgtagaaagccagtccgcagaaacggtgctgaccccggatgaatgtcagctactgggc tatctggacaagggaaaacgcaagcgcaaagagaaagcaggtagcttgcagtgggctta catggcgatagctagactgggcggttttatggacagcaagcgaaccggaattgccagctg gggcgccctctggtaaggttgggaagccctgcaaagtaaactggatggctttcttgccgcc aaggatctgatggcgcaggggatcaagatctgatcaagagacaggatgaggatcgtttcg catgattgaacaagatggattgcacgcaggttctccggccgcttgggtggagaggctattc ggctatgactgggcacaacagacaatcggctgctctgatgccgccgtgttccggctgtcag cgcaggggcgcccggttcttttttgtcaagaccgacctgtccggtgccctgaatgaactgcag gacgaggcagcgcggctatcgtggctggccacgacgggcgttccttgcgcagctgtgctcg acgttgtcactgaagcgggaagggactggctgctattgggcgaagtgccggggcaggatc tcctgtcatctcaccttgctcctgccgagaaagtatccatcatggctgatgcaatgcggcgg ctgcatacgcttgatccggctacctgcccattcgaccaccaagcgaaacatcgcatcgagc gagcacgtactcggatggaagccggtcttgtcgatcaggatgatctggacgaagagcatc aggggctcgcgccagccgaactgttcgccaggctcaaggcgcgcatgcccgacggcgag gatctcgtcgtgacccatggcgatgcctgcttgccgaatatcatggtggaaaatggccgctt ttctgattcatcgactgtggccggctgggtgtggcggaccgctatcaggacatagcgttgg ctacccgtgatattgctgaagagcttggcggcgaatgggctgaccgcttcctcgtgctttac ggtatcgccgctcccgattcgcagcgcatcgccttctatcgccttcttgacgagttcttctga gcgggactctggggttcgaaatgaccgaccaagcgacgcccaacctgccatcacgagatt tcgattccaccgccgccttctatgaaaggttgggcttcggaatcgttttccgggacgccggc tggatgatcctccagcgcggggatctcatgctggagttcttcgcccaccccagcttcaaaag cgctct | SEQ ID NO: 223 |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 218, SEQ ID NO: 219, SEQ ID NO: 220, SEQ ID NO: 221, SEQ ID NO: 222, and SEQ ID NO: 223. Table 66 Lists exemplary secretion constructs.

TABLE 66

Figure 32A:
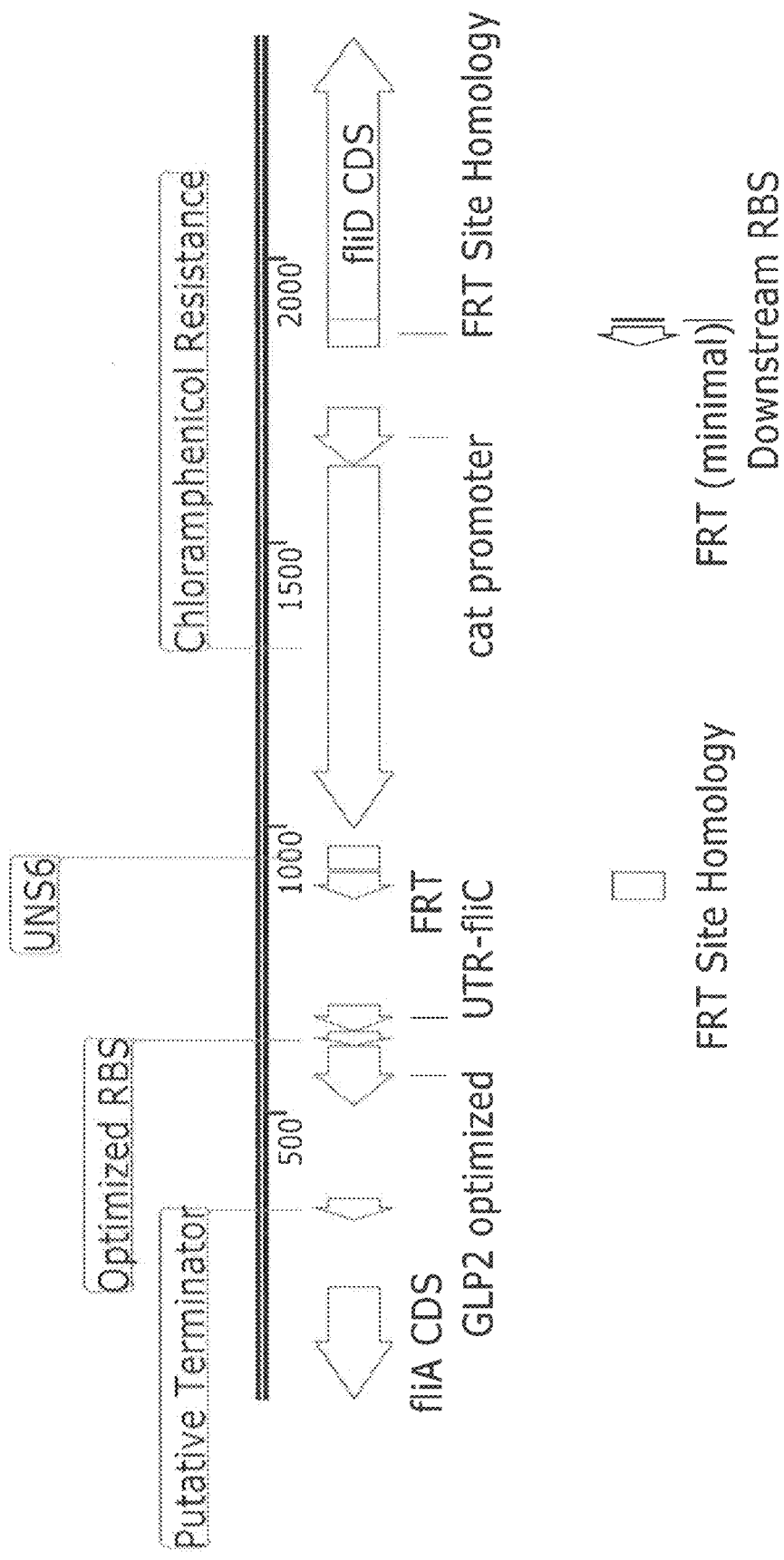
FIG. 32A, FIG. 32B, FIG. 32C, FIG. 32D, and FIG. 32E depict schematics of non-limiting examples of constructs for the expression of GLP2 for bacterial secretion.
Figure 32B:
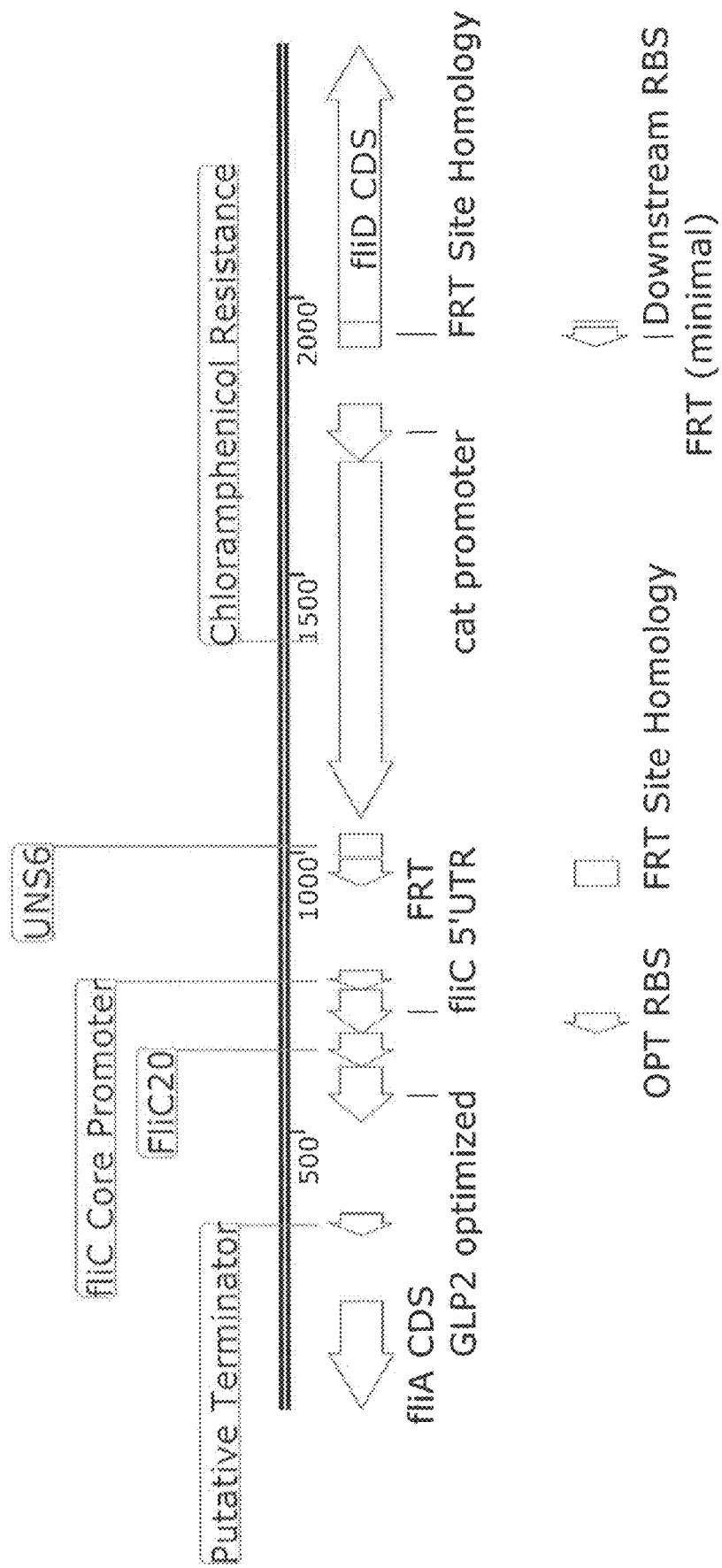

| Non-limiting Examples of Secretion Constructs | | |
| --- | --- | --- |
| Description | Sequence | SEQ ID NO: |
| FliC20-glp2; a human GLP2 construct inserted into the FliC locus, under the control of the native FliC promoter (as shown in FIG. 32A) | cgttccttgtagggcgtcatagcgttcgacggcattaagtaacccaatgcc gcccgcctgtagcagatcgtcaagttccacgctcgcgggcagtcgaacct gcaggcgcaatgcttcgtgacgcaccagcgggacataacgctgccacag cgagtgtttatccattacaccttcagcggtatagagtgaattcacgataaaca gccctgcgttatatgagttatcggcatgattatccgtttctgcagggttttaat cggacgattagtgggtgaaatgagggggttatttgggggttaccggtaaatt gcgggcagaaaaaacccgccgttggcggggaagcacgttgctggcaa attaccattcatgttgccggatgcggcgtaaacgccttatccggcctacaaa aatgtgcaaattcaataaattgcaattccccttgtaggcctgataagcgcag cgcatcaggcaatttggcgttgccgtcagtctcagttaatcaggttacggcg attaatcagtaattttagtttggatcagccaattaataaaatcacgcgccgcc agattatccaggatggtattcatttcgtcagaaaaagagccgtcagcATG cattaggaacctcccagagtttatacttgttgattacgttttgggtttccaccc gtcggctcaatcgccgtcaaccctgttatcgtctgtcgtaaaacaaccttag aattttttttcacaaacagccatttttttgttagtcgacgaaatactcttttctctgc cccttattcccgctattaaaaaaaacaattaaacgtaaactttgcgcaattca ggccgataaccccggtattcgttttacgtgtcgaaagataaaCGAAGT TCCTATACTTTCTAGAGAATAGGAACTTCGG AATAGGAACTTCATTTctcgttcgctgccacctaagaatact ctacggtcacatacAAATGGCGCGCCTTACGCCCCGC CCTGCCACTCATCGCAGTACTGTTGTATTCAT TAAGCATCTGCCGACATGGAAGCCATCACAA ACGGCATGATGAACCTGAATCGCCAGCGGCA TCAGCACCTTGTCGCCTTGCGTATAATATTTG CCCATGGTGAAAACGGGGGCGAAGAAGTTGT CCATATTGGCCACGTTTAAATCAAAACTGGT GAAACTCACCCAGGGATTGGCTGAGACGAAA AACATATTCTCAATAAACCCTTTAGGGAAAT AGGCCAGGTTTTCACCGTAACACGCCACATC TTGCGAATATATGTGTAGAAACTGCCGGAAA TCGTCGTGGTATTCACTCCAGAGCGATGAAA ACGTTTCAGTTTGCTCATGGAAAACGGTGTA ACAAGGGTGAACACTATCCCATATCACCAGC TCACCGTCTTTCATTGCCATACGTAATTCCGG ATGAGCATTCATCAGGCGGGCAAGAATGTGA ATAAAGGCCGGATAAAACTTGTGCTTATTTTT CTTTACGGTCTTTAAAAAGGCCGTAATATCC AGCTGAACGGTCTGGTTATAGGTACATTGAG CAACTGACTGAAATGCCTCAAAATGTTCTTT ACGATGCCATTGGGATATATCAACGGTGGTA TATCCAGTGATTTTTTTCTCCATTTTAGCTTCC TTAGCTCCTGAAAATCTCGACAACTCAAAAA ATACGCCCGGTAGTGATCTTATTTCATTATGG TGAAAGTTGGAACCTCTTACGTGCCGATCAA CGTCTCATTTTCGCCAAAAGTTGGCCCAGGG CTTCCCGGTATCAACAGGGACACCAGGATTT ATTTATTCTGCGAAGTGATCTTCCGTCACAGG TAGGCGCGCCGAAGTTCCTATACTTTCTAGA GAATAGGAACTTCGGAATAGGAACTctcaccgcc gcgcaaaaagcgacgctaacccctatttcaaatcagcaatcgtcgtttacc gctaaacttagcgcctacggtacgctgaaaagcgcgctgacgactttcca gaccgccaatactgcattgtctaaagccgatcttttttccgctaccagcacc accagcagcaccaccgcgttcagtgccaccaccgcgggtaatgccatcg ccgggaaatacaccatcagcgtcacccatctggcgcaggcgcaaaccct gacaacgcgcaccaccagagacgatacgaaaacggcgatcgccacca gcgacagcaaactcaccattcaacaaggcggcgacaaagatccgatttcc attgatatcagcgcggctaactcgtctttaagcgggatccgtgatgccatca acaacgcaaaagcaggcgtaagcgcaagcatcattaacgtgggtaacgg tgaatatcgtctgtcagtcacatcaaatgacaccggcct | SEQ ID NO: 224 |
| FHC20 with optimized RBS-GLP2 and UTR-FliC (as shown in FIG. 32A, in reverse orientation) | attaatcagtaattttagtttggatcagccaattaataaaatcacgcgccgcc agattatccaggatggtattcatttcgtcagaaaaagagccgtcagcATG cattaggaacctcccagagtttatacttgttgattacgttttgggtttccaccc gtcggctcaatcgccgtca | SEQ ID NO: 225 |

TABLE 66-continued

Non-limiting Examples of Secretion Constructs

| Description | Sequence | SEQ ID NO: |
|---|---|---|
| human GLP2 construct,, including the N terminal 20 amino acids of FliC (reverse orientation), inserted into the FliC locus under the control of a tet inducible promoter, with TetR and chloramphenicol resistance. (as shown in FIG. 32C) | cgttccttgtagggcgtcatagcgttcgacggcattaagtaacccaatgcc gcccgcctgtagcagatcgtcaagttccacgctcgcgggcagtcgaacct gcaggcgcaatgcttcgtgacgcaccagcgggacataacgctgccacag cgagtgtttatccattacaccttcagcggtatagagtgaattcacgataaaca gccctgcgttatatgagttatcggcatgattatccgtttctgcagggttttttaat cggacgattagtgggtgaaatgaggggttatttgggggttaccggtaaatt gcgggcagaaaaaacccgccgttggcggggaagcacgttgctggcaa attaccattcatgttgccggatgcggcgtaaacgccttatccggcctacaaa aatgtgcaaattcaataaattgcaattcccttgtaggcctgataagcgcag cgcatcaggcaatttggcgttgccgtcagtctcagttaatcaggttacggcg attaatcagtaattttagtttggatcagccaattaataaaatcacgcgccgcc agattatccaggatggtattcatttcgtcagaaaaagagccgtcagcATG cttgttgatattattttgagtgatcagcgagaggctgttggtattaatgacttgt gccatGGTCCATTCGAACCCAATTTAAGGAGTA CCCACgttgattacgttttgggtttccacccgtcggctcaatcgccgtca ttctctatcactgatagggagtggtaaaataactctatcaatgatagagtgtc aacaaaaattaggaattaatgatgtctagattagataaaagtaaagtgattaa cagcgcattagagctgcttaatgaggtcggaatcgaaggtttaacaacccg taaactcgcccagaagctaggtgtagagcagcctacattgtattggcatgt aaaaaataagcgggctttgctcgacgccttagccattgagatgttagatag gcaccatactcacttttgccctttagaaggggaaagctggcaagattttttac gtaataacgctaaaagtttagatgtgctttactaagtcatcgcgatggagca aaagtacatttaggtacacggcctacagaaaaacagtatgaaactctcgaa aatcaattagccttttttatgccaacaaggttttttcactagagaatgcattatatg cactcagcgctgtggggcatttttactttaggttgcgtattggaagatcaaga gcatcaagtcgctaaagaagaaagggaaacacctactactgatagtatgc cgccattattacgacaagctatcgaattatttgatcaccaaggtgcagagcc agccttcttattcggccttgaattgatcatatgcggattagaaaaacaactta aatgtgaaagtgggtcttaagaattttttttcacaaacagccattttttgttagtc gacgaaatactctttctctgccccttattcccgctattaaaaaaaacaattaa acgtaaactttgcgcaattcaggccgataaccccggtattcgttttacgtgtc gaaagataaaCGAAGTTCCTATACTTTCTAGAGAA TAGGAACTTCGGAATAGGAACTTCATTTctcgtt cgctgccacctaagaatactctacggtcacatacAAATGGCGCG CCTTACGCCCCGCCCTGCCACTCATCGCAGTA CTGTTGTATTCATTAAGCATCTGCCGACATGG AAGCCATCACAAACGGCATGATGAACCTGAA TCGCCAGCGGCATCAGCACCTTGTCGCCTTG CGTATAATATTTGCCCATGGTGAAAACGGGG GCGAAGAAGTTGTCCATATTGGCCACGTTTA AATCAAAACTGGTGAAACTCACCCAGGGATT GGCTGAGACGAAAAACATATTCTCAATAAAC CCTTTAGGGAAATAGGCCAGGTTTTCACCGT AACACGCCACATCTTGCGAATATATGTGTAG AAACTGCCGGAAATCGTCGTGGTATTCACTC CAGAGCGATGAAAACGTTTCAGTTTGCTCAT GGAAAACGGTGTAACAAGGGTGAACACTATC CCATATCACCAGCTCACCGTCTTTCATTGCCA TACGTAATTCCGGATGAGCATTCATCAGGCG GGCAAGAATGTGAATAAAGGCCGGATAAAA CTTGTGCTTATTTTTCTTTACGGTCTTTAAAA AGGCCGTAATATCCAGCTGAACGGTCTGGTT ATAGGTACATTGAGCAACTGACTGAAATGCC TCAAAATGTTCTTTACGATGCCATTGGGATAT ATCAACGGTGGTATATCCAGTGATTTTTTCT CCATTTTAGCTTCCTTAGCTCCTGAAAATCTC GACAACTCAAAAAATACGCCCGGTAGTGATC TTATTTCATTATGGTGAAAGTTGGAACCTCTT ACGTGCCGATCAACGTCTCATTTTCGCCAAA AGTTGGCCCAGGGCTTCCCGGTATCAACAGG GACACCAGGATTTATTTATTCTGCGAAGTGA TCTTCCGTCACAGGTAGGCGCGCCGAAGTTC CTATACTTTCTAGAGAATAGGAACTTCGGAA TAGGAACTctcaccgccgcgcaaaaagcgacgctaacccctattt caaatcagcaatcgtcgtttaccgctaaacttagcgcctacggtacgctga aaagcgcgctgacgactttccagaccgccaatactgcattgtctaaagccg atctttttccgctaccagcaccaccagcagcaccaccgcgttcagtgcca ccaccgcgggtaatgccatcgccgggaaatacaccatcagcgtcaccca tctggcgcaggcgcaaaccctgacaacgcgcaccaccagagacgatac gaaaacggcgatcgccaccagcgacagcaaactcaccattcaacaagg cggcgacaaagatccgatttccattgatatcagcgcggctaactcgtcttta agcgggatccgtgatgccatcaacaacgcaaaagcaggcgtaagcgca agcatcattaacgtgggtaacggtgaatatcgtctgtcagtcacatcaaatg acaccggcct | SEQ ID NO: 226 |

TABLE 66-continued

Non-limiting Examples of Secretion Constructs

Figure 32C:
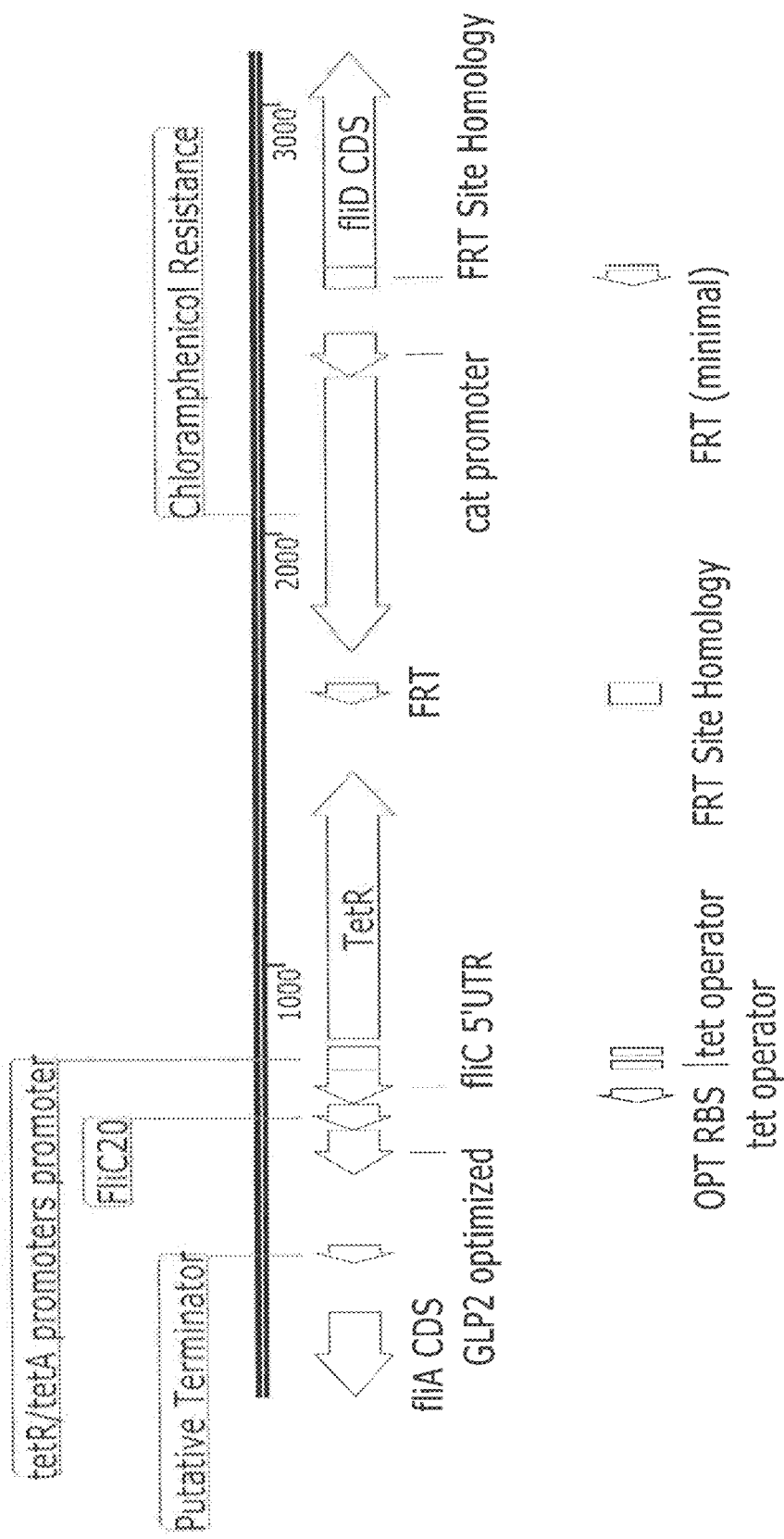
Figure 32D:
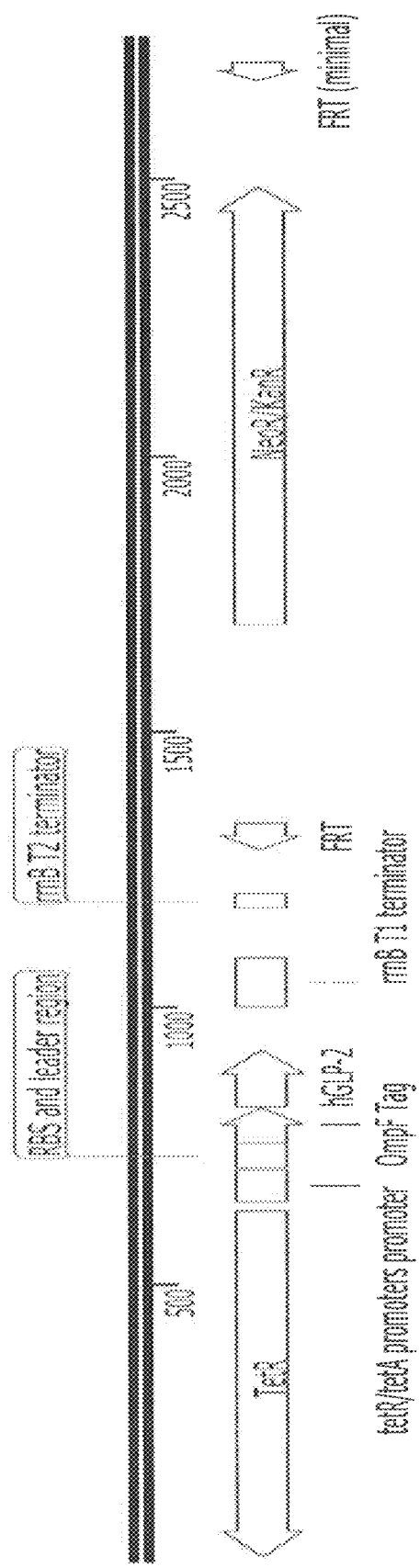
Figure 32E:
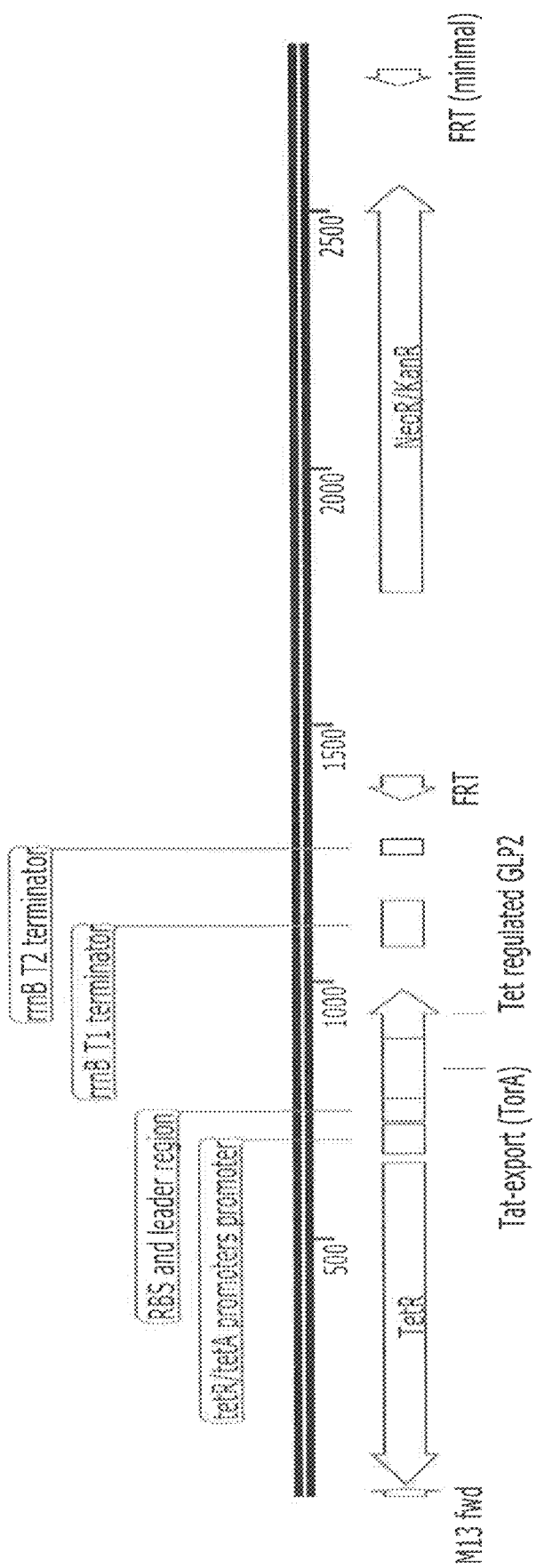

| Description | Sequence | SEQ ID NO: |
| --- | --- | --- |
| human GLP2 construct,, including the N terminal 20 amino acids of FliC (reverse orientation) | ttaatcagtaattttagtttggatcagccaattaataaaatcacgcgccgcca gattatccaggatggtattcatttcgtcagaaaaagagccgtcagcATGc ttgttgatattattttgagtgatcagcgagaggctgttggtattaatgacttgtg ccat | SEQ ID NO: 227 |
| human GLP2 construct with a N terminal OmpF secretion tag (sec-dependent secretion system) under the control of a tet inducible promoter, includes TetR in reverse direction (as shown in FIG. 32C) | ttaagacccactttcacatttaagttgttttctaatccgcatatgatcaattcaa ggccgaataagaaggctggctctgcaccttggtgatcaaataattcgatag cttgtcgtaataatggcggcatactatcagtagtaggtgtttccctttcttcttt agcgacttgatgctcttgatcttccaatacgcaacctaaagtaaaatgcccc acagcgctgagtgcatataatgcattctctagtgaaaaaccttgttggcata aaaaggctaattgattttcgagagtttcatactgtttttctgtaggccgtgtacc taaatgtacttttgctccatcgcgatgacttagtaaagcacatctaaaacttt agcgttattacgtaaaaaatcttgccagctttcccttctaaagggcaaagt gagtatggtgcctatctaacatctcaatggctaaggcgtcgagcaaagccc gcttattttttacatgccaatacaatgtaggctgctctacacctagcttctggg cgagtttacgggttgttaaaccttcgattccgacctcattaagcagctctaat gcgctgttaatcactttacttttatctaatctagacatcattaattcctaatttttgt tgacactctatcattgatagagttattttaccactccctatcagtgatagaaa aagtgaactctagaaataattttgtttaactttaagaaggagatatacatatga tgaagcgcaatattctggcagtgatcgtccctgctctgttagtagcaggtac tgcaaacgctcatgctgatggtctttctctgatgagatgaacaccattcttga taatcttgccgccagggactttataaactggttgattcagaccaaaatcactg acaggtgacacattccccgaaaagtgccgatggcccccgatggtagtg tggccccatgcgagagtagggaactgccaggcatcaaataaaacgaaag gctcagtcgaaagactgggcctttcgttttatctgttgtttgtcggtgaacgct ctcctgagtaggacaaatccgccgggagcggatttgaacgttgcgaagca acggcccggagggtggcgggcaggacgcccgccataaactgccaggc atcaaattaagcagaaggccatcctgacggatggccttttttgcgtggccag tgccaagcttgcatgcagattgcagcattacacgtcttgagcgattgtgtag gctggagctgcttcgaagttcctatactttctagagaataggaacttcggaat aggaacttc | SEQ ID NO: 228 |
| human GLP2 construct with a N terminal OmpF secretion tag (sec-dependent secretion system) (as shown in FIG. 32C) | atgatgaagcgcaatattctggcagtgatcgtccctgctctgttagtagcag gtactgcaaacgctcatgctgatggtctttctctgatgagatgaacaccatt cttgataatcttgccgccagggactttataaactggttgattcagaccaaaat cactgacaggtga | SEQ ID NO: 229 |
| human GLP2 construct with a N terminal TorA secretion tag (tat secretion system) under the control of a tet inducible promoter (as shown in FIG. 32E) | taagacccactttcacatttaagttgttttctaatccgcatatgatcaattcaa ggccgaataagaaggctggctctgcaccttggtgatcaaataattcgatag cttgtcgtaataatggcggcatactatcagtagtaggtgtttccctttcttcttt agcgacttgatgctcttgatcttccaatacgcaacctaaagtaaaatgcccc acagcgctgagtgcatataatgcattctctagtgaaaaaccttgttggcata aaaaggctaattgattttcgagagtttcatactgtttttctgtaggccgtgtacc taaatgtacttttgctccatcgcgatgacttagtaaagcacatctaaaacttt agcgttattacgtaaaaaatcttgccagctttcccttctaaagggcaaagt gagtatggtgcctatctaacatctcaatggctaaggcgtcgagcaaagccc gcttattttttacatgccaatacaatgtaggctgctctacacctagcttctggg cgagtttacgggttgttaaaccttcgattccgacctcattaagcagctctaat gcgctgttaatcactttacttttatctaatctagacatcattaattcctaatttttgt tgacactctatcattgatagagttattttaccactccctatcagtgatagaaa aagtgaactctagaaataattttgtttaactttaagaaggagatatacatAT GAACAATAACGATCTCTTTCAGGCATCACGT CGGCGTTTTCTGGCACAACTCGGCGGCTTAA CCGTCGCCGGGATGCTGGGGCCGTCATTGTT AACGCCGCGACGTGCGACTGCGcatgctgatggttctt tctctgatgagatgaacaccattcttgataatcttgccgccagggactttata aactggttgattcagaccaaaatcactgactaataacacatttccccgaaaa gtgccgatggcccccgatggtagtgtggcccatgcgagagtagggaac tgccaggcatcaaataaaacgaaaggctcagtcgaaagactgggcctttc gttttatctgttgtttgtcggtgaacgctctcctgagtaggacaaatccgccg ggagcggatttgaacgttgcgaagcaacggcccggagggtggcgggca ggacgcccgccataaactgccaggcatcaaattaagcagaaggccatcc tgacggatggccttttttgcgtggccagtgccaagcttgcatgcagattgca gcattacacgtcttgagcgattgtgtaggctggagctgcttcgaagttcctat actttctagagaataggaacttcggaataggaacttc | SEQ ID NO: 230 |

TABLE 66-continued

Non-limiting Examples of Secretion Constructs

| Description | Sequence | SEQ ID NO: |
|---|---|---|
| GLP-2 with TORA tag | ATGAACAATAACGATCTCTTTCAGGCATCAC<br>GTCGGCGTTTTCTGGCACAACTCGGCGGCTT<br>AACCGTCGCCGGGATGCTGGGGCCGTCATTG<br>TTAACGCCGCGACGTGCGACTGCGcatgctgatggt<br>tctttctctgatgagatgaacaccattcttgataatcttgccgccagggactttataaactggttgattcagaccaaaatcactgac | SEQ ID NO: 231 |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 224, SEQ ID NO: 225, SEQ ID NO: 226, SEQ ID NO: 227. SEQ ID NO: 228, SEQ ID NO: 229. SEQ ID NO: 230, and SEQ ID NO: 231. Table 67 lists exemplary secretion constructs.

TABLE 67

Non-limiting Examples of Secretion Constructs

| Description | Sequences | SEQ ID NO |
|---|---|---|
| Ptet-phoA-hIL10 | gaattcgttaagacccactttcacatttaagttgtttttctaatccgcatat<br>gatcaattcaaggccgaataagaaggctggctctgcaccttggtgatca<br>aataattcgatagcttgtcgtaataatggcggcatactatcagtagtagg<br>tgtttcccttcttcttagcgacttgatgctcttgatcttccaatacgcaac<br>ctaaagtaaaatgccccacagcgctgagtgcatataatgcattctctagt<br>gaaaaaccttgttggcataaaaaggctaattgattttcgagagtttcata<br>ctgtttttctgtaggccgtgtacctaaatgtacttttgctccatcgcgatga<br>cttagtaaagcacatctaaaacttttagcgttattacgtaaaaaatcttgc<br>cagctttcccttctaaagggcaaaagtgagtatggtgcctatctaacatc<br>tcaatggctaaggcgtcgagcaaagcccgcttatttttttacatgccaatac<br>aatgtaggctgctctacacctagcttctgggcgagtttacgggttgttaaa<br>ccttcgattccgacctcattaagcagctctaatgcgctgttaatcactttac<br>ttttatctaatctagacatcattaattcctaattttttgttgacactctatcatt<br>gatagagttatttttaccactccctatcagtgatagagaaaagtgaa<br><u>GACGCCAGAGAGTTAAGGGGGTTAAATGAA</u><br>ACAATCGACCATCGCATTGGCGCTGCTTCCTC<br>TATTGTTCACACCGGTGACAAAGGCA<br>TCGCCAGGTCAAGGAACGCAGTCAGAGAATT<br>CATGCACTCACTTTCCGGGCAATCTGCCGAA<br>TATGCTGCGCGATCTGCGAGATGCATTCTCTC<br>GCGTGAAAACGTTCTTTCAAATGAAAGATCA<br>ACTGGATAATCTGCTGCTGAAGGAGTCGTTG<br>TTGGAGGATTTTAAGGGGTATCTGGGTTGTC<br>AAGCACTGTCTGAAATGATTCAATTTTACTTG<br>GAGGAAGTTATGCCGCAAGCGGAAAACCAA<br>GATCCGGATATTAAGGCGCACGTGAACTCAC<br>TGGGCGAAAACCTGAAAACTTTGCGCCTGCG<br>TCTGAGACGATGTCACCGATTCCTGCCGTGT<br>GAAAACAAGTCAAAGGCGGTTGAGCAAGTT<br>AAGAATGCTTTCAATAAGCTGCAAGAAAAGG<br>GCATCTATAAAGCGATGTCTGAATTTGATAT<br>CTTTATAAACTACATAGAAGCTTATATGACT<br>ATGAAGATTCGAAATTAA | SEQ ID NO: 232 |
| phoA-hIL10 | <u>GACGCCAGAGAGTTAAGGGGGTTAAATGAA</u><br>ACAATCGACCATCGCATTGGCGCTGCTTCCTC<br>TATTGTTCACACCGGTGACAAAGGCA<br>TCGCCAGGTCAAGGAACGCAGTCAGAGAATT<br>CATGCACTCACTTTCCGGGCAATCTGCCGAA<br>TATGCTGCGCGATCTGCGAGATGCATTCTCTC<br>GCGTGAAAACGTTCTTTCAAATGAAAGATCA<br>ACTGGATAATCTGCTGCTGAAGGAGTCGTTG<br>TTGGAGGATTTTAAGGGGTATCTGGGTTGTC<br>AAGCACTGTCTGAAATGATTCAATTTTACTTG<br>GAGGAAGTTATGCCGCAAGCGGAAAACCAA<br>GATCCGGATATTAAGGCGCACGTGAACTCAC<br>TGGGCGAAAACCTGAAAACTTTGCGCCTGCG<br>TCTGAGACGATGTCACCGATTCCTGCCGTGT<br>GAAAACAAGTCAAAGGCGGTTGAGCAAGTT<br>AAGAATGCTTTCAATAAGCTGCAAGAAAAGG<br>GCATCTATAAAGCGATGTCTGAATTTGATAT<br>CTTTATAAACTACATAGAAGCTTATATGACT<br>ATGAAGATTCGAAATTAA | SEQ ID NO: 233 |

TABLE 67-continued

Non-limiting Examples of Secretion Constructs

| Description | Sequences | SEQ ID NO |
|---|---|---|
| fliC UTR-RBS-pvIL10 | tgacggcgattgagccgacgggtggaaacccaaaacgtaatcaact<br>caaatcccttaataaggaggtaaaATGGGTACTGACCAA<br>TGTGATAATTTCCCACAAATGCTGCGTGATTT<br>GCGCGACGCTTTCTCGCGTGTGAAAACTTTTT<br>TTCAGACTAAAGATGAGGTGGATAATCTGCT<br>GCTGAAAGAGAGCCTGTTGGAAGATTTTAAA<br>GGCTACTTGGGCTGTCAAGCGCTGTCGGAGA<br>TGATTCAATTTTATCTGGAAGAGGTGATGCC<br>GCAAGCTGAGAACCAAGATCCGGAAGCGAA<br>AGATCACGTGAATTCGCTGGGCGAGAATCTG<br>AAAACTCTGCGTCTGCGTCTGCGTCGTTGTCA<br>CCGTTTTTTGCCGTGCGAAAACAAAAGTAAA<br>GCTGTTGAGCAAATTAAAAACGCTTTTAACA<br>AACTGCAGGAAAAAGGTATCTATAAAGCGAT<br>GAGCGAATTTGATATTTTTATTAATTATATTG<br>AAGCTTATATGACTATTAAAGCTCGCTAA | SEQ ID NO: 2334 |
| Ptet-phoA-vIL10 | Gaattcgttaagacccactttcacatttaagttgtttttctaatccgcatat<br>gatcaattcaaggccgaataagaaggctggctctgcaccttggtgatca<br>aataattcgatagcttgtcgtaataatggcggcatactatcagtagtagg<br>tgtttccctttcttcttttagcgacttgatgctcttgatcttccaatacgcaac<br>ctaaagtaaaatgccccacagcgctgagtgcatataatgcattctctagt<br>gaaaaaccttgttggcataaaaaggctaattgattttcgagagtttcata<br>ctgttttttctgtaggccgtgtacctaaatgtacttttgctccatcgcgatga<br>cttagtaaagcacatctaaaacttttagcgttattacgtaaaaaatcttgc<br>cagctttcccttctaaagggcaaaagtgagtatggtgcctatctaacatc<br>tcaatggctaaggcgtcgagcaaagcccgcttatttttttacatgccaatac<br>aatgtaggctgctctacacctagcttctgggcgagtttacgggttgttaaa<br>ccttcgattccgacctcattaagcagctctaatgcgctgttaatcactttac<br>ttttatctaatctagacatcattaatttcctaattttttgttgacactctatcatt<br>gatagagttattttaccactccctatcagtgatagagaaaagtgaa<br><u>GACGCCAGAGAGTTAAGGGGGTTAAATGAA<br>ACAATCGACCATCGCATTGGCGCTGCTTCCTC<br>TATTGTTCACACCGGTGACAAAGGCA<br>GGTACAGACCAATGTGACAATTTTCCCCAAA<br>TGTTGAGGGACCTAAGAGATGCCTTCAGTCG<br>TGTTAAAACCTTTTTCCAGACAAAGGACGAG<br>GTAGATAACCTTTTGCTCAAGGAGTCTCTGCT<br>AGAGGACTTTAAGGGCTACCTTGGATGCCAG<br>GCCCTGTCAGAAATGATCCAATTCTACCTGG<br>AGGAAGTCATGCCACAGGCTGAAAACCAGG<br>ACCCTGAAGCCAAAGACCATGTCAATTCTTT<br>GGGTGAAAATCTAAAGACCCTACGGCTCCGC<br>CTGCGCCGTTGCCACAGGTTCCTGCCGTGTG<br>AGAACAAGAGTAAAGCTGTGGAACAGATAA<br>AAAATGCCTTTAACAAGCTGCAGGAAAAAGG<br>AATTTACAAAGCCATGAGTGAATTTGACATT<br>TTTATTAACTACATAGAAGCATACATGACAA<br>TTAAAGCCAGG</u> | SEQ ID NO: 235 |
| phoA-vIL10 | <u>GACGCCAGAGAGTTAAGGGGGTTAAATGAA<br>ACAATCGACCATCGCATTGGCGCTGCTTCCTC<br>TATTGTTCACACCGGTGACAAAGGCA<br>GGTACAGACCAATGTGACAATTTTCCCCAAA<br>TGTTGAGGGACCTAAGAGATGCCTTCAGTCG<br>TGTTAAAACCTTTTTCCAGACAAAGGACGAG<br>GTAGATAACCTTTTGCTCAAGGAGTCTCTGCT<br>AGAGGACTTTAAGGGCTACCTTGGATGCCAG<br>GCCCTGTCAGAAATGATCCAATTCTACCTGG<br>AGGAAGTCATGCCACAGGCTGAAAACCAGG<br>ACCCTGAAGCCAAAGACCATGTCAATTCTTT<br>GGGTGAAAATCTAAAGACCCTACGGCTCCGC<br>CTGCGCCGTTGCCACAGGTTCCTGCCGTGTG<br>AGAACAAGAGTAAAGCTGTGGAACAGATAA<br>AAAATGCCTTTAACAAGCTGCAGGAAAAAGG<br>AATTTACAAAGCCATGAGTGAATTTGACATT<br>TTTATTAACTACATAGAAGCATACATGACAA<br>TTAAAGCCAGG</u> | SEQ ID NO: 236 |
| Ptet-PhoA-IL22 | Gaattcgttaagacccactttcacatttaagttgtttttctaatccgcatat<br>gatcaattcaaggccgaataagaaggctggctctgcaccttggtgatca<br>aataattcgatagcttgtcgtaataatggcggcatactatcagtagtagg<br>tgtttccctttcttcttttagcgacttgatgctcttgatcttccaatacgcaac<br>ctaaagtaaaatgccccacagcgctgagtgcatataatgcattctctagt<br>gaaaaaccttgttggcataaaaaggctaattgattttcgagagtttcata<br>ctgttttttctgtaggccgtgtacctaaatgtacttttgctccatcgcgatga | SEQ ID NO: 237 |

TABLE 67-continued

Non-limiting Examples of Secretion Constructs

| Description | Sequences | SEQ ID NO |
|---|---|---|
| | cttagtaaagcacatctaaaacttttagcgttattacgtaaaaaatcttgc<br>cagctttccccttctaaagggcaaaagtgagtatggtgcctatctaacatc<br>tcaatggctaaggcgtcgagcaaagcccgcttatttttttacatgccaatac<br>aatgtaggctgctctacacctagcttctgggcgagtttacggggttgttaaa<br>ccttcgattccgacctcattaagcagctctaatgcgctgttaatcactttac<br>ttttatctaatctagacatcattaattcctaattttttgttgacactctatcatt<br>gatagagttattttaccactccctatcagtgatagagaaaagtgaa<br>GACGCCAGAGAGTTAAGGGGGTTAAATGAA<br>ACAATCGACCATCGCATTGGCGCTGCTTCCTC<br>TATTGTTCACACCGGTGACAAAGGCA<br>GCACCGATCTCTTCCCACTGTCGCTTAGATAA<br>ATCGAATTTTCAACAACCTTATATTACGAATC<br>GTACGTTTATGCTGGCTAAAGAAGCGTCATT<br>AGCTGATAACAACACTGATGTTCGCCTGATT<br>GGTGAGAAATTGTTTCACGGTGTGTCTATGTC<br>AGAACGTTGCTACCTGATGAAACAAGTTCTG<br>AATTTCACCCTGGAAGAAGTGTTGTTTCCGC<br>AATCTGACCGCTTTCAACCGTATATGCAAGA<br>GGTTGTGCCGTTTCTGGCGCGCCTGAGTAATC<br>GCCTGAGCACTTGTCATATTGAGGGCGACGA<br>CCTGCATATTCAACGAAATGTTCAAAAATTG<br>AAAGATACGGTGAAGAAACTGGGTGAAAGT<br>GGTGAAATCAAAGCGATTGGTGAGCTGGATC<br>TGCTGTTTATGTCATTGCGCAATGCGTGCATT<br>TAA | |
| PhoA-IL22 | GACGCCAGAGAGTTAAGGGGGTTAAATGAA<br>ACAATCGACCATCGCATTGGCGCTGCTTCCTC<br>TATTGTTCACACCGGTGACAAAGGCA<br>GCACCGATCTCTTCCCACTGTCGCTTAGATAA<br>ATCGAATTTTCAACAACCTTATATTACGAATC<br>GTACGTTTATGCTGGCTAAAGAAGCGTCATT<br>AGCTGATAACAACACTGATGTTCGCCTGATT<br>GGTGAGAAATTGTTTCACGGTGTGTCTATGTC<br>AGAACGTTGCTACCTGATGAAACAAGTTCTG<br>AATTTCACCCTGGAAGAAGTGTTGTTTCCGC<br>AATCTGACCGCTTTCAACCGTATATGCAAGA<br>GGTTGTGCCGTTTCTGGCGCGCCTGAGTAATC<br>GCCTGAGCACTTGTCATATTGAGGGCGACGA<br>CCTGCATATTCAACGAAATGTTCAAAAATTG<br>AAAGATACGGTGAAGAAACTGGGTGAAAGT<br>GGTGAAATCAAAGCGATTGGTGAGCTGGATC<br>TGCTGTTTATGTCATTGCGCAATGCGTGCATT<br>TAA | SEQ ID NO:<br>238 |
| | GACGCCAGAGAGTTAAGGGGGTTAAATGAA<br>ACAATCGACCATCGCATTGGCGCTGCTTCCTC<br>TATTGTTCACACCGGTGACAAAGGCA | SEQ ID NO:<br>239 |

In some embodiments, genetically engineered bacteria comprise a nucleic acid sequence that is at least about 80%, at least about 85%, at least about 90%, at least about 95%, or at least about 99% homologous to the DNA sequence of SEQ ID NO: 232, SEQ ID NO: 233, SEQ ID NO: 234, SEQ ID NO: 235, SEQ ID NO: 236, SEQ ID NO: 237, SEQ ID NO: 238, and SEQ ID NO: 239.

Example 27

Bacterial Secretion of hIL-10 and vIL-10

To determine whether the human IL-10 and vIL-10 expressed by engineered bacteria is secreted, the concentration of IL-10 in the bacterial supernatant from a selection of engineered strains comprising various hIL-10 and vIL-10 constructs/strains was measured (see Table 63, Table 64, Table 65, Table 66, Table 67 for components and sequences for hIL-10 and vIL-10 constructs/strains).

E. coli Nissle comprising various tet-inducible constructs or constructs under the native fliC promoter were grown overnight in LB medium. Cultures were diluted 1:200 in LB and grown shaking (200 rpm) for 2 hours. Cultures were diluted to an optical density of 0.5 at which time anhydrous tetracycline (ATC) was added to cultures at a concentration of 100 ng/mL to induce expression of hIL-10. No tetracycline was added to cultures harboring the fliC constructs. After 12 hours of induction, cells were spun down, and supernatant was collected. To generate cell free medium, the clarified supernatant was further filtered through a 0.22 micron filter to remove any remaining bacteria and placed on ice. Additionally, to detect intracellular recombinant protein production, pelleted were bacteria washed and resuspended in BugBuster™ (Millipore) with protease inhibitors and Ready-Lyse Lysozyme Solution (Epicentre), resulting in lysate concentrated 10-fold compared to original culture conditions. After incubation at room temperature for 10 minutes unsoluble debris is spun down at 20 min at 12,000 rcf at 4.0 then placed on ice until further processing.

The concentration of hIL-10 in the cell-free medium and in the bacterial cell extract was measured by hIL-10 ELISA (R&D Systems DY217B), according to manufacturer's instructions. Similarly, to determine the concentrations of vIL-10 an Ultrasensitive ELISA kit (Alpco, 45-I10HUU-E01) was employed using commercially available recombinant vIL-10 (R&D Systems, 915-VL-010). All samples were run in triplicate, and a standard curve was used to calculate secreted levels of IL-10. Standard curves were generated using both human and viral recombinant proteins. Wild type Nissle was included in the ELISA as a negative control, and no signal was observed. Table 68 and Table 69 summarize levels of hIL10 and vIL-10 measured in the supernatant and intracellularly Table 68 and extracellularly Table 69. The data show that both vIL-10 and hIL-10 are secreted at various levels from the different bacterial strains.

TABLE 68 hIL-10 Secretion

| Sample | hu IL-10 (ng/ml) (intracellular) | hu IL-10 (ng/ml) (extracellular) |
|---|---|---|
| WT | 0 | 0 |
| IL-10 Plasmid (Nissle pUC57.Ptet-phoA-hIL10) | 30.6 | 8.4 |
| IL-10 plasmid/lpp (lpp::Cm pUC57.Ptet-phoA-hIL10) | 33.1 | 19.3 |
| 2083 IL-10 plasmid/nlpI (nlpI::Cm pUC57.Ptet-phoA-hIL10) | 31.2 | 20.5 |
| 2084 IL-10 plasmid/tolA (tolA::Cm pUC57.Ptet-phoA-hIL10) | 59.9 | 21.4 |
| 2085 IL-10 plasmid/pal (PAL::Cm pUC57.Ptet-phoA-hIL10) | ~70 | 28.4 |

TABLE 69 vIL-10 Secretion

| Sample | vIL-10 (ng/ml) (intracellular) | vIL-10 (ng/ml) (extracellular) |
|---|---|---|
| WT | 0 | 0 |
| fliC-pvIL10 (Nissle pUN fli-vIL10 Kan Cm) | 6.4 | 29 |
| fliC ::vIL10 (Nissle fliC::vIL10 delta fliD CmR) | 8.4 | 9 |
| vIL-10 lpp (Nissle lpp mutant with vIL10 pBR3222 tet plasmid) | 124.1 | 527 |
| vIL-10 nlpI (Nissle delta nlpI::CmR pBR322.Ptet-phoA-vIL10) | 279.7 | 982 |
| vIL-10 tolA (Nissle delta tolA::CmR pBR322.Ptet-phoA-vIL10) | 205.9 | 428 |
| vIL-10 pal (Nissle delta PAL::CmR pBR322.Ptet-phoA-vIL10 | 491.2 | 1090 |

Co-Culture Studies

To determine whether the hIL-10 and viral IL-10 expressed by the genetically engineered bacteria shown in Table 68 and Table 69 is biologically functional, in vitro experimentation is conducted, in which the bacterial supernatant containing secreted human or viral IL-10 is added to the growth medium of a Raji cells (a hematopoietic cell line) and J774a1 cells (a macrophage cell line). IL-10 is known to induce the phosphorylation of STAT3 in these cells Functional activity of bacterially secreted IL-10 is therefore assessed by its ability to phosphorylate STAT3 in Raji and J774a1 cells.

Raji cells are grown in RPMI 1640 supplemented with 10% FBS supplemented with 10% fetal bovine serum at 37° C. in a humidified incubator supplemented with 5% CO2. Prior to treatment with the bacterial supernatant, RPMI 1640 supplemented with 10% FBS (1e6/24 well) are serum starved overnight. Titrations of either recombinant human IL-10 diluted in LB or clarified supernatant from wild type Nissle or the engineered bacteria are added to cells for 30 minutes. Cells are harvested and resuspended in lysis buffer, and phospho-STAT3 ELISA (ELISA pSTAT3 (Tyr705) (Cell Signaling Technology)) is run in triplicate for all samples, according to manufacturer's instructions. PBS-treated cells and PBS are added as negative controls. Dilutions of samples are included to demonstrate linearity.

Competition Studies

As an additional control for specificity, a competition assay is performed. Titrations of anti-IL10 antibody are pre-incubated with constant concentrations of either rhIL22 (data not shown) or supernatants from the engineered bacteria expressing human or viral IL-22 for 15 min. Next, the supernatants/rhIL2 solutions are added to serum-starved Raji cells (1e6/well) and cells are incubated for 30 min followed by pSTAT3 ELISA as described above.

In other embodiments, similar studies are conducted with J774a1 cells.

Example 27

Bacterial Secretion of GLP-2

To determine whether the human GLP-2 expressed by engineered bacteria is secreted, the concentration of GLP-2 in the bacterial supernatant from a two engineered strains comprising GLP-2 constructs/strains was measured. The first strain comprising a deletion in PAL and a plasmid expressing GLP-2 with an OmpF secretion tag from a tetracycline-inducible promoter and the second strain comprises the same PAL deletion and the same plasmid expressing GLP-2, further comprising a deletion in degP (see Table 70).

E. coli Nissle comprising various tet-inducible constructs or constructs under the native fliC promoter were grown overnight in LB medium. Cultures were diluted 1:200 in LB and grown shaking (200 rpm) for 2 hours. Cultures were diluted to an optical density of 0.5 at which time anhydrous tetracycline (ATC) was added to cultures at a concentration of 100 ng/mL to induce expression of hIL-10. No tetracycline was added to cultures harboring the fliC constructs. After 12 hours of induction, cells were spun down, and supernatant was collected. To generate cell free medium, the clarified supernatant was further filtered through a 0.22 micron filter to remove any remaining bacteria and placed on ice. Additionally, to detect intracellular recombinant protein production, pelleted were bacteria washed and resuspended in BugBuster™ (Millipore) with protease inhibitors and Ready-Lyse Lysozyme Solution (Epicentre), resulting in lysate concentrated 10-fold compared to original culture conditions. After incubation at room temperature for 10 minutes unsoluble debris is spun down at 20 min at 12,000 rcf at 4.0 then placed on ice until further processing.

The concentration of GLP-2 in the cell-free medium and in the bacterial cell extract was measured by Human GLP2 ELISA Kit (Competitive EIA) (LSBio), according to manufacturer's instructions. All samples were run in triplicate, and a standard curve was used to calculate secreted levels of GLP-2. Standard curves were generated using recombinant GLP-2. Wild type Nissle was included in the ELISA as a negative control, and no signal was observed. As seen in Table 70, deletion of degP, a periplasmic protease, improved secretion levels over 3-fold.

TABLE 70

GLP-2 Secretion

| DOM mut | ng/ml |
|---|---|
| WT | 1.14 |
| PAL ompF(PAL::Cm pBR322 Ptet-ompF-GLP2) | 3.74 |
| PAL degP ompF(Nissle PAL::Cm degP::Kan pBR322 Ptet-ompF-GLP2) | 12.98 |

Co-Culture Studies

To determine whether the hGLP-2 expressed by the genetically engineered bacteria is biologically functional, in vitro experimentation is conducted, in which the bacterial supernatant (from both strains shown above) containing secreted human GLP-2 is added to the growth medium of Caco-2 cells and CCD-18Co cells. The Caco-2 cell line is a continuous cell of heterogeneous human epithelial colorectal adenocarcinoma cells. As described e.g., in Jasleen et al. (Dig Dis Sci. 2002 May; 47(5):1135-40) GLP-2 stimulates proliferation and [3H]thymidine incorporation in Caco-2 and T84 cells. Additionally, GLP-2 stimulates VEGFA secretion in these cells (see., e.g., Bulut et al, Eur J Pharmacol. 2008 Jan. 14; 578(2-3):279-85.

Functional activity of bacterially secreted GLP-2 is therefore assessed by its ability to induce proliferation and VEGF secretion.

Caco-2 are grown in Dulbecco's modified Eagle's medium supplemented with 10% fetal bovine serum at 37° C. in a humidified incubator supplemented with 5% CO2. Prior to treatment with the bacterial supernatant, Caco-2 cells (1e6/24 well) are serum starved overnight. Titrations of either recombinant human GLP-2 (50 and 250 nM) diluted in LB or clarified supernatant from wild type Nissle or the engineered bacteria are added to cells for a defined time.

For cell proliferation assays, cells are harvested and resuspended in lysis buffer. The cells are assayed after 12, 24, 48, and 72 hours of incubation. Cell proliferation is measured using a Cell proliferation assay kit according to manufacturers instruction (e.g., a Cell viability was assessed by a 3-[4, 5-dimethylthiazol-2-yl]-2, 5-diphenyl-tetrazolium bromide (MTT)-assay).

For the measurements of VEFA secretion, cells are harvested and resuspended in lysis buffer, and concentrations of GLP-2 in the medium are determined ELISA PBS-treated cells and PBS are added as negative controls. Dilutions of samples are included to demonstrate linearity.

Competition Studies

As an additional control for specificity, a competition assay is performed. Titrations of anti-GLP-2 antibody are pre-incubated with constant concentrations of either recombinant GLP-2 or supernatants from the engineered bacteria for 15 min. Next, the supernatants/rhIL2 solutions are added to serum-starved Cac-2 cells (1e6/well) and cells are incubated for 30 min followed by VEGFA ELISA as described above.

Example 28

Bacterial Secretion of IL-22

To determine whether the human IL-22 expressed by engineered bacteria is secreted, the concentration of IL-22 in the bacterial supernatant from a two engineered strains comprising IL-22 constructs/strains was measured. The first strain comprising a deletion in PAL and a plasmid expressing IL-22 with an OmpF secretion tag from a tetracycline-inducible promoter and the second strain comprises the same PAL deletion and the same plasmid expressing IL-22, further comprising a deletion in degP (Table 71).

E. coli Nissle comprising various tet-inducible constructs or constructs under the native fliC promoter were grown overnight in LB medium. Cultures were diluted 1:200 in LB and grown shaking (200 rpm) for 2 hours. Cultures were diluted to an optical density of 0.5 at which time anhydrous tetracycline (ATC) was added to cultures at a concentration of 100 ng/mL to induce expression of hIL-10. No tetracycline was added to cultures harboring the fliC constructs. After 12 hours of induction, cells were spun down, and supernatant was collected. To generate cell free medium, the clarified supernatant was further filtered through a 0.22 micron filter to remove any remaining bacteria and placed on ice. Additionally, to detect intracellular recombinant protein production, pelleted were bacteria washed and resuspended in BugBuster™ (Millipore) with protease inhibitors and Ready-Lyse Lysozyme Solution (Epicentre), resulting in lysate concentrated 10-fold compared to original culture conditions. After incubation at room temperature for 10 minutes unsoluble debris is spun down at 20 min at 12,000 rcf at 4.0 then placed on ice until further processing.

The concentration of IL-22 in the cell-free medium and in the bacterial cell extract was measured by hIL-22 ELISA (R&D Systems (DY782) ELISA for hIL-22), according to manufacturer's instructions. All samples were run in triplicate, and a standard curve was used to calculate secreted levels of IL-22. Standard curves were generated using recombinant IL-22. Wild type Nissle was included in the ELISA as a negative control, and no signal was observed. Table 71 summarizes levels of IL-22 measured in the supernatant. The data show that both hIL-22 are secreted at various levels from the different bacterial strains.

TABLE 71

IL-22 Secretion

| Genotype | IL-22 Production/Secretion Dilution Corrected (ng/ml) |
|---|---|
| WT | 20.7 |
| Lpp (delta lpp::CmR expressing PhoA-IL22 from Ptet) | 87.6 |
| nlpI (delta nlpI::CmR expressing PhoA-IL22 from Ptet) | 105.4 |
| tolA (delta tolA::CmR expressing PhoA-IL22 from Ptet) | 623.2 |
| PAL (delta pal::CmR expressing PhoA-IL22 from Ptet) | 328.8 |

Example 29

Bacterial Secretion of IL-22 and Functional Assays

Generation of Bacterial Supernatant and Measurement of IL-22 Concentration

To determine whether the human IL-22 expressed by engineered bacteria is secreted, the concentration of IL-22 in the bacterial supernatant was measured.

*E. coli* Nissle comprising a tet-inducible integrated construct (delta pal::CmR expressing PhoA-IL22 from Ptet) was grown overnight in LB medium. Cultures were diluted 1:200 in LB and grown shaking (200 rpm) for 2 hours. Cultures were diluted to an optical density of 0.5 at which time anhydrous tetracycline (ATC) was added to cultures at a concentration of 100 ng/mL to induce expression of hIL-22. After 12 hours of induction, cells were spun down, and supernatant was collected. To generate cell free medium, the supernatant was centrifuged, and filtered through a 0.22 micron filter to remove any remaining bacteria.

The concentration of hIL-22 in the cell-free medium was measured by hIL-22 ELISA (R&D Systems (DY782) ELISA for hIL-22), according to manufacturer's instructions. All samples were run in triplicate, and a standard curve was used to calculate secreted levels of IL-22. Additionally, samples were diluted to ensure absence of matrix effects and to demonstrate linearity. Wild type Nissle was included in the ELISA as a negative control, and no signal was observed. The engineered bacteria comprising a PAL deletion and the integrated construct encoding hIL-22 with a phoA secretion tag were determined to be secreting at 199 ng/ml supernatant.

Co-Culture Studies

To determine whether the hIL-22 expressed by the genetically engineered bacteria is biologically functional, in vitro experimentation was conducted, in which the bacterial supernatant containing secreted human IL-22 was added to the growth medium of a mammalian colonic epithelial cell line. IL-22 is known to induce the phosphorylation of STAT1 and STAT3 in Colo205 cells (see, e.g., Nagalakshmi et al., Interleukin-22 activates STAT3 and induces IL-10 by colon epithelial cells. Int Immunopharmacol. 2004 May; 4(5):679-91). Functional activity of bacterially secreted IL-22 was therefore assessed by its ability to phosphorylate STAT3 in Colo205 cells.

Figure 33A:
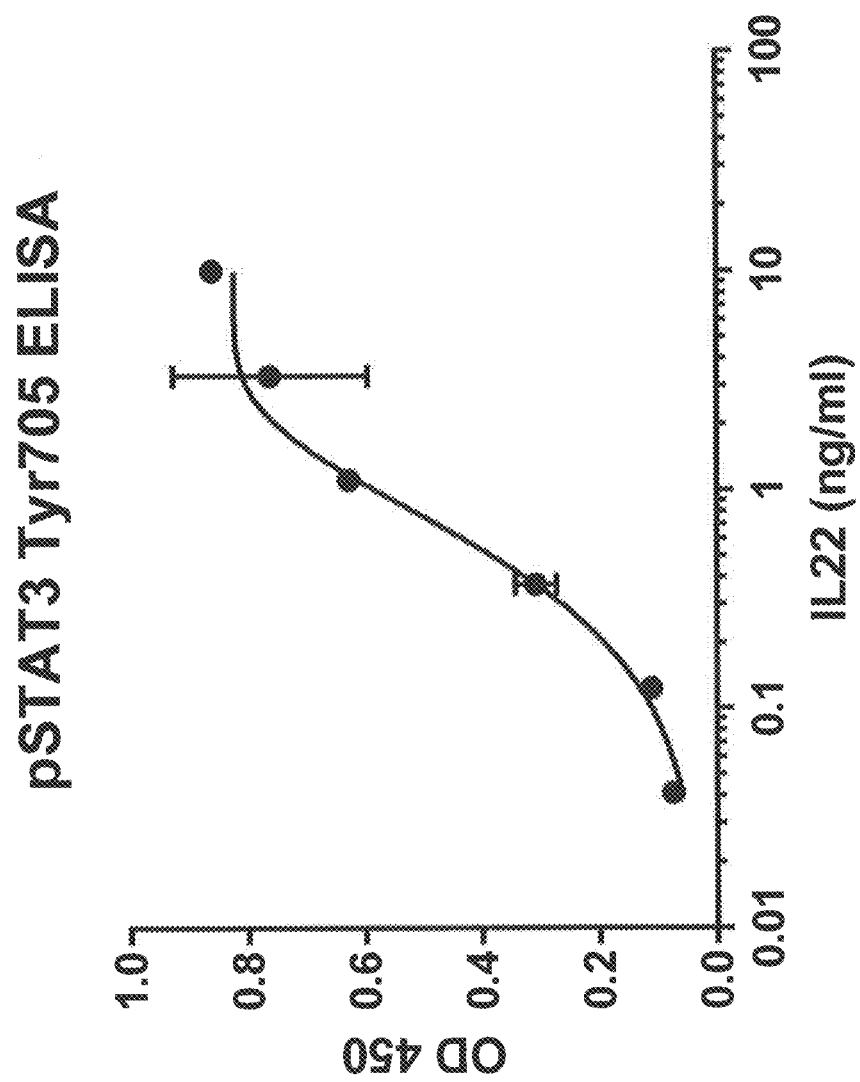
FIG. 33A and FIG. 33B depict line graphs of ELISA results.

Colo205 cells were grown in Dulbecco's modified Eagle's medium supplemented with 10% fetal bovine serum at 37° C. in a humidified incubator supplemented with 5% CO2. Prior to treatment with the bacterial supernatant, Colo205 (1e6/24 well) were serum starved overnight. Titrations of either recombinant human IL-22 diluted in LB or clarified supernatant from wild type Nissle or the engineered bacteria were added to cells for 30 minutes. Cells were harvested and resuspended in lysis buffer, and phospho-STAT3 ELISA (ELISA pSTAT3 (Tyr705) (Cell Signaling Technology)) was run in triplicate for all samples, according to manufacturer's instructions. PBS-treated cells and PBS were added as negative controls. Dilutions of samples were included to demonstrate linearity. No signal was observed for wild type Nissle. Results for the engineered strain comprising a PAL deletion and the integrated construct encoding hIL-22 with a phoA secretion tag are shown in FIG. 33A, and demonstrate that hIL-22 secreted from the engineered bacteria is functionally active.

Competition Studies

Figure 33B:
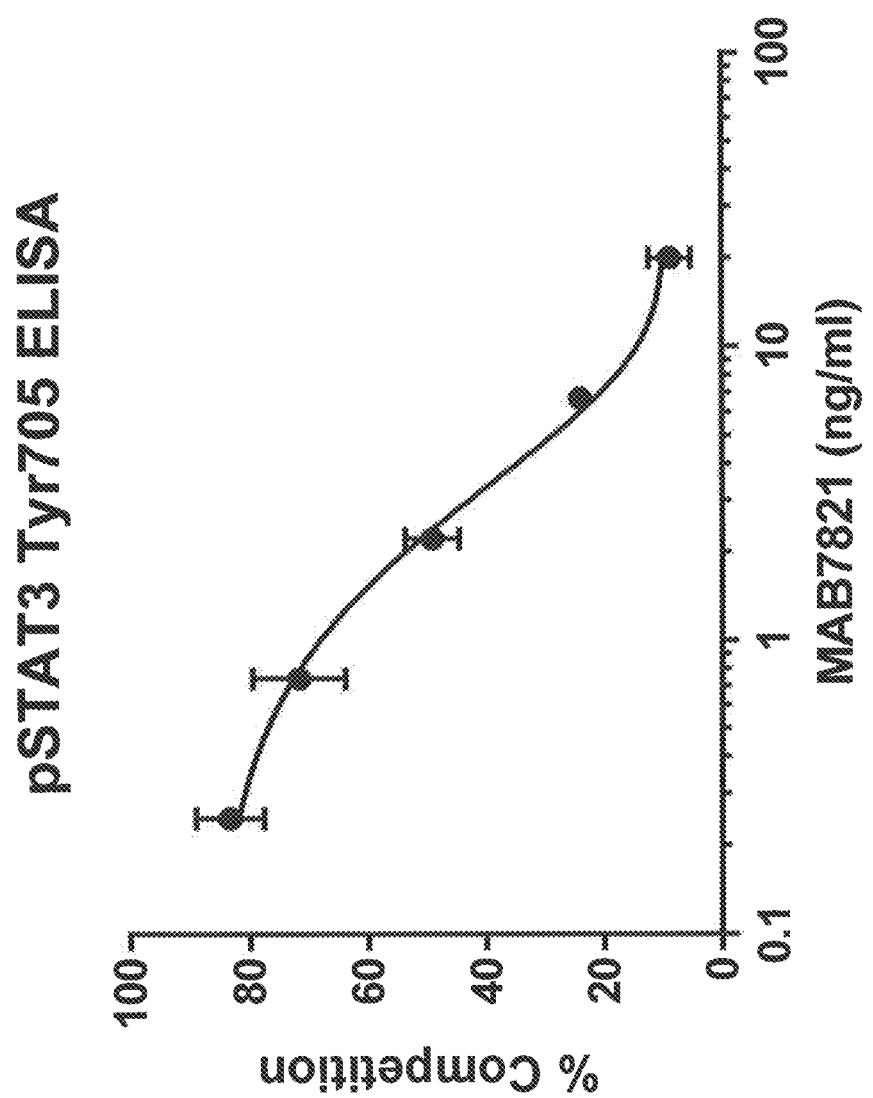
Figure 34:
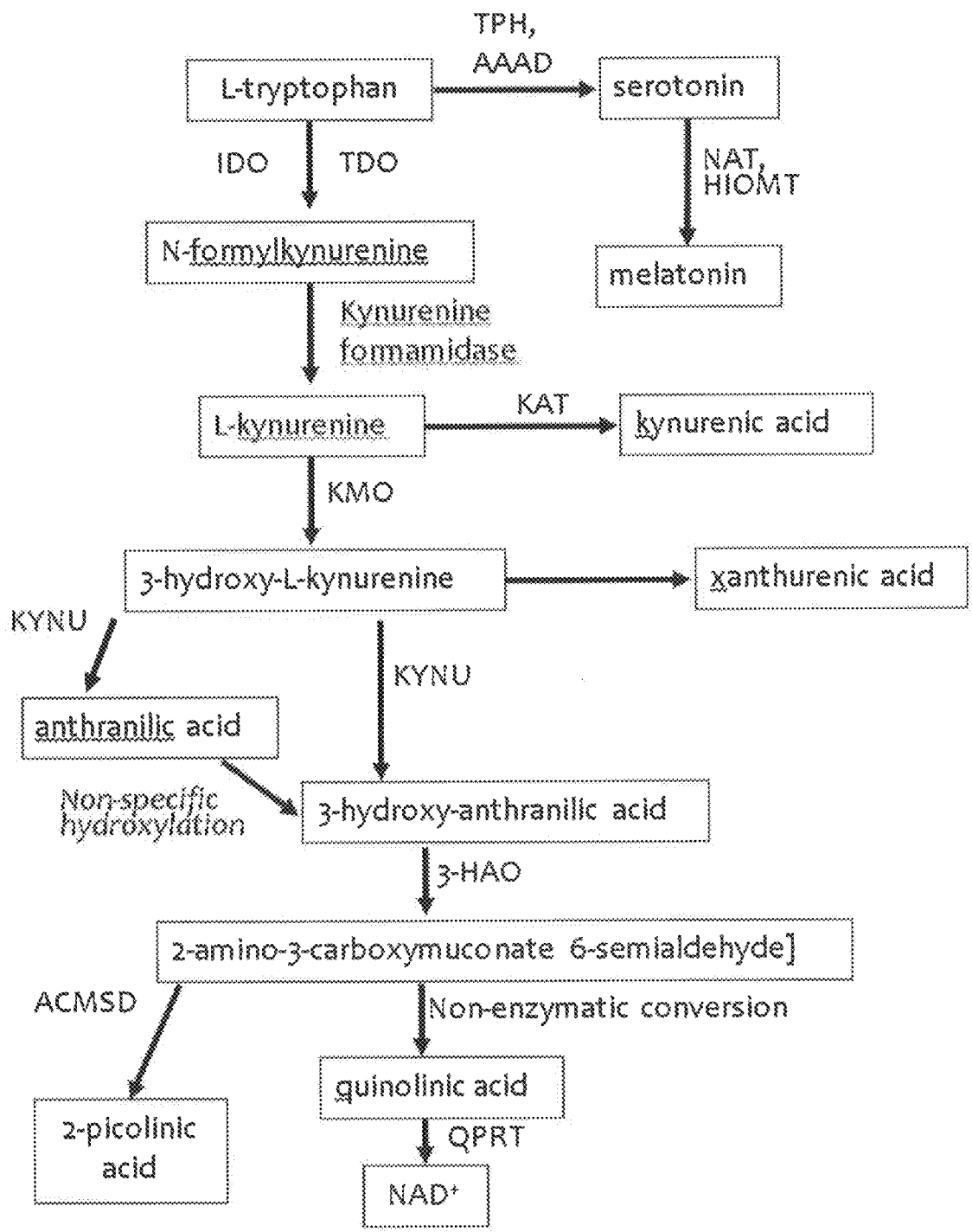
FIG. 34 depicts a schematic of tryptophan metabolism along the kynurenine and the serotonin arms in humans. The abbreviations for the enzymes are as follows: 3-HAO: 3-hydroxyl-anthranilate 3,4-dioxidase; AAAD: aromatic-amino acid decarboxylase; ACMSD, alpha-amino-beta-carboxymuconate-epsilon-semialdehyde decarboxylase; HIOMT, hydroxyl-O-methyltransferase; IDO, indoleamine 2,3-dioxygenase; KAT, kynurenine amino transferases I-III; KMO: kynurenine 3-monooxygenase; KYNU, kynureninase; NAT, N-acetyltransferase; TDO, tryptophan 2,3-dioxygenase; TPH, tryptophan hydroxylase; QPRT, quinolinic acid phosphoribosyl transferase.
Figure 35:
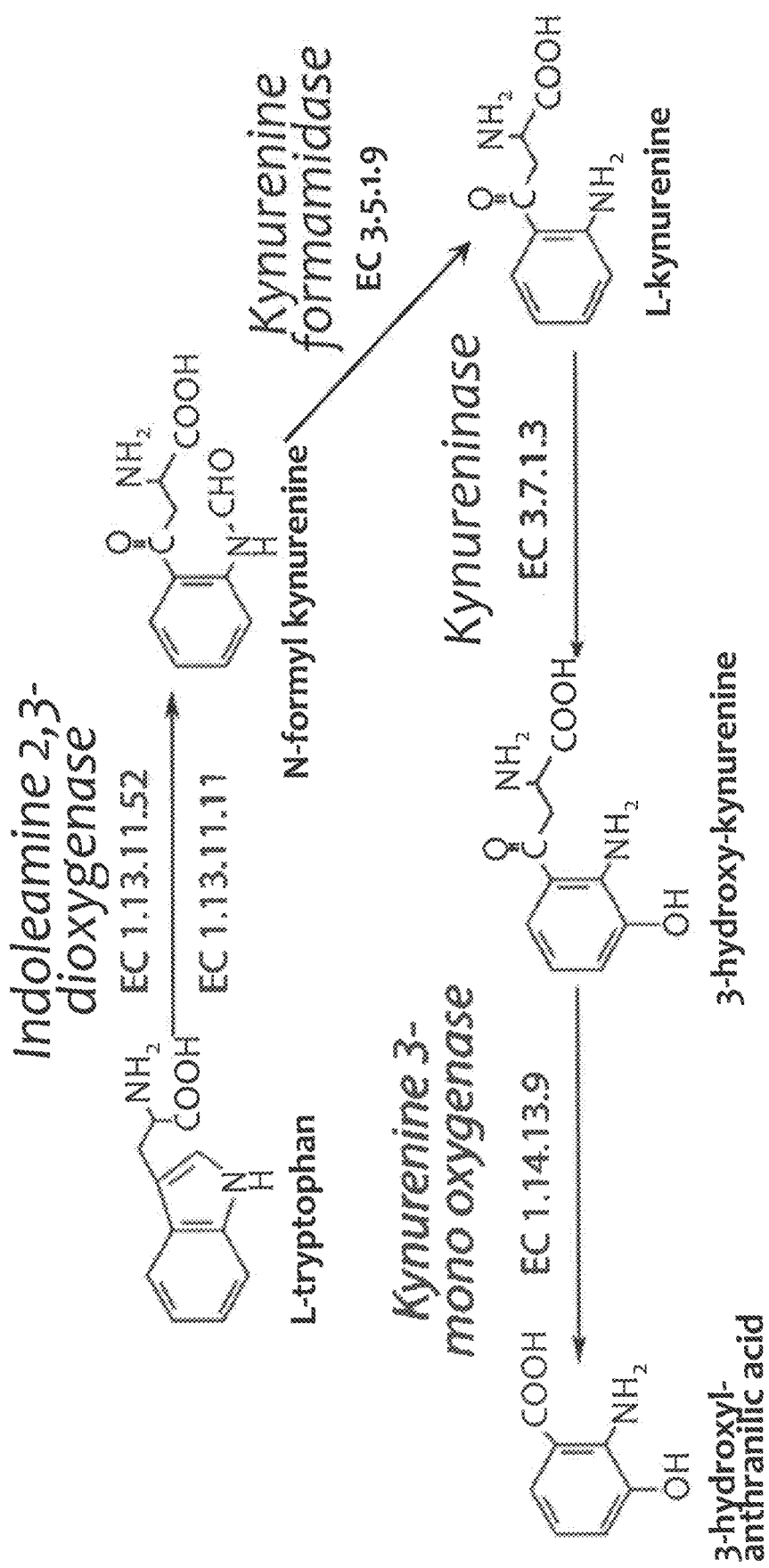
FIG. 35 depicts a schematic of bacterial tryptophan catabolism machinery, which is genetically and functionally homologous to IDO1 enzymatic activity, as described in Vujkovic-Cvijin et al., Dysbiosis of the gut microbiota is associated with HIV disease progression and tryptophan catabolism; Sci Transl Med. 2013 Jul. 10; 5(193): 193ra91, the contents of which is herein incorporated by reference in its entirety. In certain embodiments of the disclosure, the genetically engineered bacteria comprise gene cassettes comprising one or more of the bacterial tryptophan metabolism enzymes depicted in FIG. 35. In certain embodiments, the genetically engineered bacteria comprise one or more gene cassettes which produce one or more of the metabolites depicted in FIG. 35, including but not limited to, kynurenine, indole-3-aldehyde, indole-3-acetic acid, and/or indole-3 acetaldehyde.

As an additional control for specificity, a competition assay was performed. Titrations of anti-IL22 antibody (MAB7821, R&D Systems) were pre-incubated with constant concentrations of either rhIL22 (data not shown) or supernatants from the engineered bacteria for 15 min. Next, the supernatants/rhIL2 solutions were added to serum-starved Colo205 cells (1e6/well) and cells were incubated for 30 min followed by pSTAT3 ELISA as described above. As shown in FIG. 33B, the phospho-Stat3 signal induced by the secreted hIL-22 is competed by the hIL-22 antibody MAB7821.

Example 30

Generation of Indole Propionic Acid Strain and In Vitro Indole Production

To facilitate inducible production of indole propionic acid (IPA) in *Escherichia coli* Nissle, 6 genes allowing the production of indole propionic acid from tryptophan, as well as transcriptional and translational elements, are synthesized (Gen9, Cambridge, Mass.) and cloned into vector pBR322 under a tet inducible promoter. In other embodiments, the IPA synthesis cassette is put under the control of an FNR, RNS or ROS promoter, e.g., described herein, or other promoter induced by conditions in the healthy or diseased gut, e.g., inflammatory conditions. For efficient translation of IPA synthesis genes, each synthetic gene in the cassette is separated by a 15 base pair ribosome binding site derived from the T7 promoter/translational start site.

The IPA synthesis cassette comprises TrpDH (tryptophan dehydrogenase from *Nostoc punctiforme* NIES-2108), FldH1/FldH2 (indole-3-lactate dehydrogenase from *Clostridium sporogenes*), FldA (indole-3-propionyl-CoA: indole-3-lactate CoA transferase from *Clostridium sporogenes*), FldBC (indole-3-lactate dehydratase from *Clostridium sporogenes*), FldD (indole-3-acrylyl-CoA reductase from *Clostridium sporogenes*), and AcuI (acrylyl-CoA reductase from *Rhodobacter sphaeroides*).

The tet inducible IPA construct described above is transformed into *E. coli* Nissle as described herein and production of IPA is assessed. In certain embodiments, *E. coli* Nissle strains containing the IPA synthesis cassette described further comprise a tryptophan synthesis cassette. In certain embodiments, the strains comprise a feedback resistant version of AroG and TrpE to achieve greater Trp production. In certain embodiments, additionally, the tnaA gene (tryptophanase converting Trp into indole) is deleted.

All incubations are performed at 37° C. LB-grown overnight cultures of *E. coli* Nissle transformed with the IPA biosynthesis construct alone or in combination with a tryptophan biosyntehsis construct and feedback resistant AroG and TrpE are subcultured 1:100 into 10 mL of M9 minimal medium containing 0.5% glucose and grown shaking (200 rpm) for 2 h, at which time anhydrous tetracycline (ATC) is added to cultures at a concentration of 100 ng/mL to induce expression of the IPA biosynthesis and tryptophan biosynthesis constructs. After 2 hours of induction, cells are spun down, supernatant is discarded, and the cells are resuspended in M9 minimal media containing 0.5% glucose. Culture supernatant is then analyzed at predetermined time points (e.g., 0 up to 24 hours) by LC-MS to assess levels of IPA.

Production of IPA is also assessed in *E. coli* Nissle strains containing the IPA and tryptophan cassettes both driven by an RNS promoter e.g., a nsrR-norB-IPA biosynthesis construct) in order to assess nitrogen dependent induction of IPA production. Overnight bacterial cultures are diluted 1:100 into fresh LB and grown for 1.5 hrs to allow entry into early log phase. At this point, long half-life nitric oxide donor (DETA-NO; diethylenetriamine-nitric oxide adduct) was added to cultures at a final concentration of 0.3 mM to induce expression from plasmid. After 2 hours of induction, cells are spun down, supernatant is discarded, and the cells are resuspended in M9 minimal media containing 0.5% glucose. Culture supernatant is then analyzed at predetermined time points (0 up to 24 hours, as shown in FIG. 33) to assess IPA levels.

In alternate embodiments, production of IPA is also assessed in E. coli Nissle strains containing the IPA and tryptophan cassettes both driven by the low oxygen inducible FNR promoter, e.g., FNRS, or the reactive oxygen regulated OxyS promoter.

Example 31

FNR Promoter Activity

In order to measure the promoter activity of different FNR promoters, the lacZ gene, as well as transcriptional and translational elements, were synthesized (Gen9, Cambridge, Mass.) and cloned into vector pBR322. The lacZ gene was placed under the control of any of the exemplary FNR promoter sequences disclosed in Table 21. The nucleotide sequences of these constructs are shown in Table 72 through Table 76 ((SEQ ID NO: 240-244). However, as noted above, the lacZ gene may be driven by other inducible promoters in order to analyze activities of those promoters, and other genes may be used in place of the lacZ gene as a readout for promoter activity, exemplary results are shown in FIG. 39.

Table 72 shows the nucleotide sequence of an exemplary construct comprising a gene encoding lacZ, and an exemplary FNR promoter, $P_{fnr1}$ (SEQ ID NO: 240). The construct comprises a translational fusion of the Nissle nirB1 gene and the lacZ gene, in which the translational fusions are fused in frame to the $8^{th}$ codon of the lacZ coding region. The $P_{fnr1}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 73 shows the nucleotide sequence of an exemplary construct comprising a gene encoding lacZ, and an exemplary FNR promoter, $P_{fnr2}$ ((SEQ ID NO: 241). The construct comprises a translational fusion of the Nissle ydfZ gene and the lacZ gene, in which the translational fusions are fused in frame to the $8^{th}$ codon of the lacZ coding region. The $P_{fnr2}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 74 shows the nucleotide sequence of an exemplary construct comprising a gene encoding lacZ, and an exemplary FNR promoter, $P_{fnr3}$ ((SEQ ID NO: 242). The construct comprises a transcriptional fusion of the Nissle nirB gene and the lacZ gene, in which the transcriptional fusions use only the promoter region fused to a strong ribosomal binding site. The $P_{fnr3}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 75 shows the nucleotide sequence of an exemplary construct comprising a gene encoding lacZ, and an exemplary FNR promoter, $P_{fnr4}$ ((SEQ ID NO: 243). The construct comprises a transcriptional fusion of the Nissle ydfZ gene and the lacZ gene. The $P_{fnr4}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 76 shows the nucleotide sequence of an exemplary construct comprising a gene encoding lacZ, and an exemplary FNR promoter, PfnrS ((SEQ ID NO: 244). The construct comprises a transcriptional fusion of the anaerobically induced small RNA gene, fnrS1, fused to lacZ. The $P_{fnrs}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

TABLE 72

Pfnr1-lacZ construct Sequences
Nucleotide sequences of Pfnr1-lacZ construct,
low-copy (SEQ ID NO: 240)

GGTACCgtcagcataacaccctgacctctcattaattgttcatgccgggc ggcactatcgtcgtccggcctttcctctcttactctgctacgtacatct atttctataaatccgttcaatttgtctgtttttgcacaaacatgaaata tcagacaattccgtgacttaagaaaatttatacaaatcagcaatataccc cttaaggagtatataaaggtgaatttgatttacatcaataagcggggttg ctgaatcgttaaggtaggcggtaatagaaaagaaatcgaggcaaaaATGa gcaaagtcagactcgcaattatGGATCCTCTGGCCGTCGTATTACAACGT

CGTGACTGGGAAAACCCTGGCGTTACCCAACTTAATCGCCTTGCGGCACA

TCCCCCTTTCGCCAGCTGGCGTAATAGCGAAGAGGCCCGCACCGATCGCC

CTTCCCAACAGTTGCGCAGCCTGAATGGCGAATGGCGCTTTGCCTGGTTT

CCGGCACCAGAAGCGGTGCCGGAAAGCTGGCTGGAGTGCGATCTTCCTGA

CGCCGATACTGTCGTCGTCCCCTCAAACTGGCAGATGCACGGTTACGATG

CGCCTATCTACACCAACGTGACCTATCCCATTACGGTCAATCCGCCGTTT

GTTCCCGCGGAGAATCCGACAGGTTGTTACTCGCTCACATTTAATATTGA

TGAAAGCTGGCTACAGGAAGGCCAGACGCGAATTATTTTTGATGGCGTTA

ACTCGGCGTTTCATCTGTGGTGCAACGGGCGCTGGGTCGGTTACGGCCAG

GACAGCCGTTTGCCGTCTGAATTTGACCTGAGCGCATTTTTACGCGCCGG

AGAAAACCGCCTCGCGGTGATGGTGCTGCGCTGGAGTGACGGCAGTTATC

TGGAAGATCAGGATATGTGGCGGATGAGCGGCATTTTCCGTGACGTCTCG

TTGCTGCATAAACCGACCACGCAAATCAGCGATTTCCAAGTTACCACTCT

CTTTAATGATGATTTCAGCCGCGCGGTACTGGAGGCAGAAGTTCAGATGT

ACGGCGAGCTGCGCGATGAACTGCGGGTGACGGTTTCTTTGTGGCAGGGT

GAAACGCAGGTCGCCAGCGGCACCGCGCCTTTCGGCGGTGAAATTATCGA

TGAGCGTGGCGGTTATGCCGATCGCGTCACACTACGCCTGAACGTTGAAA

ATCCGGAACTGTGGAGCGCCGAAATCCCGAATCTCTATCGTGCAGTGGTT

GAACTGCACACCGCCGACGGCACGCTGATTGAAGCAGAAGCCTGCGACGT

CGGTTTCCGCGAGGTGCGGATTGAAAATGGTCTGCTGCTGCTGAACGGCA

TABLE 72-continued

Pfnr1-lacZ construct Sequences
Nucleotide sequences of Pfnr1-lacZ construct,
low-copy (SEQ ID NO: 240)

AGCCGTTGCTGATTCGCGGCGTTAACCGTCACGAGCATCATCCTCTGCAT

GGTCAGGTCATGGATGAGCAGACGATGGTGCAGGATATCCTGCTGATGAA

GCAGAACAACTTTAACGCCGTGCGCTGTTCGCATTATCCGAACCATCCGC

TGTGGTACACGCTGTGCGACCGCTACGGCCTGTATGTGGTGGATGAAGCC

AATATTGAAACCCACGGCATGGTGCCAATGAATCGTCTGACCGATGATCC

GCGCTGGCTACCCGCGATGAGCGAACGCGTAACGCGGATGGTGCAGCGCG

ATCGTAATCACCCGAGTGTGATCATCTGGTCGCTGGGGAATGAATCAGGC

CACGGCGCTAATCACGACGCGCTGTATCGCTGGATCAAATCTGTCGATCC

TTCCCGCCCGGTACAGTATGAAGGCGGCGGAGCCGACACCACGGCCACCG

ATATTATTTGCCCGATGTACGCGCGCGTGGATGAAGACCAGCCCTTCCCG

GCGGTGCCGAAATGGTCCATCAAAAAATGGCTTTCGCTGCCTGGAGAAAT

GCGCCCGCTGATCCTTTGCGAATATGCCCACGCGATGGGTAACAGTCTTG

GCGGCTTCGCTAAATACTGGCAGGCGTTTCGTCAGTACCCCCGTTTACAG

GGCGGCTTCGTCTGGGACTGGGTGGATCAGTCGCTGATTAAATATGATGA

AAACGGCAACCCGTGGTCGGCTTACGGCGGTGATTTTGGCGATACGCCGA

ACGATCGCCAGTTCTGTATGAACGGTCTGGTCTTTGCCGACCGCACGCCG

CATCCGGCGCTGACGGAAGCAAAACACCAACAGCAGTATTTCCAGTTCCG

TTTATCCGGGCGAACCATCGAAGTGACCAGCGAATACCTGTTCCGTCATA

GCGATAACGAGTTCCTGCACTGGATGGTGGCACTGGATGGCAAGCCGCTG

GCAAGCGGTGAAGTGCCTCTGGATGTTGGCCCGCAAGGTAAGCAGTTGAT

TGAACTGCCTGAACTGCCGCAGCCGGAGAGCGCCGGACAACTCTGGCTAA

CGGTACGCGTAGTGCAACCAAACGCGACCGCATGGTCAGAAGCCGGACAC

ATCAGCGCCTGGCAGCAATGGCGTCTGGCGGAAAACCTCAGCGTGACACT

CCCCTCCGCGTCCCACGCCATCCCTCAACTGACCACCAGCGGAACGGATT

TTTGCATCGAGCTGGGTAATAAGCGTTGGCAATTTAACCGCCAGTCAGGC

TTTCTTTCACAGATGTGGATTGGCGATGAAAAACAACTGCTGACCCCGCT

GCGCGATCAGTTCACCCGTGCGCCGCTGGATAACGACATTGGCGTAAGTG

AAGCGACCCGCATTGACCCTAACGCCTGGGTCGAACGCTGGAAGGCGGCG

GGCCATTACCAGGCCGAAGCGGCGTTGTTGCAGTGCACGGCAGATACACT

TGCCGACGCGGTGCTGATTACAACCGCCCACGCGTGGCAGCATCAGGGGA

AAACCTTATTTATCAGCCGGAAAACCTACCGGATTGATGGGCACGGTGAG

ATGGTCATCAATGTGGATGTTGCGGTGGCAAGCGATACACCGCATCCGGC

GCGGATTGGCCTGACCTGCCAGCTGGCGCAGGTCTCAGAGCGGGTAAACT

GGCTCGGCCTGGGGCCGCAAGAAAACTATCCCGACCGCCTTACTGCAGCC

TGTTTTGACCGCTGGGATCTGCCATTGTCAGACATGTATACCCCGTACGT

CTTCCCGAGCGAAAACGGTCTGCGCTGCGGGACGCGCGAATTGAATTATG

GCCCACACCAGTGGCGCGGCGACTTCCAGTTCAACATCAGCCGCTACAGC

CAACAACAACTGATGGAAACCAGCCATCGCCATCTGCTGCACGCGGAAGA

TABLE 72-continued

Pfnr1-lacZ construct Sequences
Nucleotide sequences of Pfnr1-lacZ construct,
low-copy (SEQ ID NO: 240)

AGGCACATGGCTGAATATCGACGGTTTCCATATGGGGATTGGTGGCGACG

ACTCCTGGAGCCCGTCAGTATCGGCGGAATTCCAGCTGAGCGCCGGTCGC

TACCATTACCAGTTGGTCTGGTGTCAAAAATAA

TABLE 73

Pfnr2-lacZ construct sequences
Nucleotide sequences of Pfnr2-lacZ construct,
low-copy (SEQ ID NO: 241)

GGTACCcatttcctctcatcccatccggggtgagagtctttttccccgac ttatggctcatgcatgcatcaaaaaagatgtgagcttgatcaaaaacaaa aaatatttcactcgacaggagtatttatattgcgcccgttacgtgggctt cgactgtaaatcagaaaggagaaaacacctATGacgacctacgatcgGGA

TCCTCTGGCCGTCGTATTACAACGTCGTGACTGGGAAAACCCTGGCGTTA

CCCAACTTAATCGCCTTGCGGCACATCCCCCTTTCGCCAGCTGGCGTAAT

AGCGAAGAGGCCCGCACCGATCGCCCTTCCCAACAGTTGCGCAGCCTGAA

TGGCGAATGGCGCTTTGCCTGGTTTCCGGCACCAGAAGCGGTGCCGGAAA

GCTGGCTGGAGTGCGATCTTCCTGACGCCGATACTGTCGTCGTCCCCTCA

AACTGGCAGATGCACGGTTACGATGCGCCTATCTACACCAACGTGACCTA

TCCCATTACGGTCAATCCGCCGTTTGTTCCCGCGGAGAATCCGACAGGTT

GTTACTCGCTCACATTTAATATTGATGAAAGCTGGCTACAGGAAGGCCAG

ACGCGAATTATTTTTGATGGCGTTAACTCGGCGTTTCATCTGTGGTGCAA

CGGGCGCTGGGTCGGTTACGGCCAGGACAGCCGTTTGCCGTCTGAATTTG

ACCTGAGCGCATTTTTACGCGCCGGAGAAAACCGCCTCGCGGTGATGGTG

CTGCGCTGGAGTGACGGCAGTTATCTGGAAGATCAGGATATGTGGCGGAT

GAGCGGCATTTTCCGTGACGTCTCGTTGCTGCATAAACCGACCACGCAAA

TCAGCGATTTCCAAGTTACCACTCTCTTTAATGATGATTTCAGCCGCGCG

GTACTGGAGGCAGAAGTTCAGATGTACGGCGAGCTGCGCGATGAACTGCG

GGTGACGGTTTCTTTGTGGCAGGGTGAAACGCAGGTCGCCAGCGGCACCG

CGCCTTTCGGCGGTGAAATTATCGATGAGCGTGGCGGTTATGCCGATCGC

GTCACACTACGCCTGAACGTTGAAAATCCGGAACTGTGGAGCGCCGAAAT

CCCGAATCTCTATCGTGCAGTGGTTGAACTGCACACCGCCGACGGCACGC

TGATTGAAGCAGAAGCCTGCGACGTCGGTTTCCGCGAGGTGCGGATTGAA

AATGGTCTGCTGCTGCTGAACGGCAAGCCGTTGCTGATTCGCGGCGTTAA

CCGTCACGAGCATCATCCTCTGCATGGTCAGGTCATGGATGAGCAGACGA

TGGTGCAGGATATCCTGCTGATGAAGCAGAACAACTTTAACGCCGTGCGC

TGTTCGCATTATCCGAACCATCCGCTGTGGTACACGCTGTGCGACCGCTA

CGGCCTGTATGTGGTGGATGAAGCCAATATTGAAACCCACGGCATGGTGC

CAATGAATCGTCTGACCGATGATCCGCGCTGGCTACCCGCGATGAGCGAA

TABLE 73-continued

Pfnr2-lacZ construct sequences
Nucleotide sequences of Pfnr2-lacZ construct,
low-copy (SEQ ID NO: 241)

CGCGTAACGCGGATGGTGCAGCGCGATCGTAATCACCCGAGTGTGATCAT

CTGGTCGCTGGGGAATGAATCAGGCCACGGCGCTAATCACGACGCGCTGT

ATCGCTGGATCAAATCTGTCGATCCTTCCCGCCCGGTACAGTATGAAGGC

GGCGGAGCCGACACCACGGCCACCGATATTATTTGCCCGATGTACGCGCG

CGTGGATGAAGACCAGCCCTTCCCGGCGGTGCCGAAATGGTCCATCAAAA

AATGGCTTTCGCTGCCTGGAGAAATGCGCCCGCTGATCCTTTGCGAATAT

GCCCACGCGATGGGTAACAGTCTTGGCGGCTTCGCTAAATACTGGCAGGC

GTTTCGTCAGTACCCCGTTTACAGGGCGGCTTCGTCTGGGACTGGGTGG

ATCAGTCGCTGATTAAATATGATGAAAACGGCAACCCGTGGTCGGCTTAC

GGCGGTGATTTTGGCGATACGCCGAACGATCGCCAGTTCTGTATGAACGG

TCTGGTCTTTGCCGACCGCACGCCGCATCCGGCGCTGACGGAAGCAAAAC

ACCAACAGCAGTATTTCCAGTTCCGTTTATCCGGGCGAACCATCGAAGTG

ACCAGCGAATACCTGTTCCGTCATAGCGATAACGAGTTCCTGCACTGGAT

GGTGGCACTGGATGGCAAGCCGCTGGCAAGCGGTGAAGTGCCTCTGGATG

TTGGCCCGCAAGGTAAGCAGTTGATTGAACTGCCTGAACTGCCGCAGCCG

GAGAGCGCCGGACAACTCTGGCTAACGGTACGCGTAGTGCAACCAAACGC

GACCGCATGGTCAGAAGCCGGACACATCAGCGCCTGGCAGCAATGGCGTC

TGGCGGAAAACCTCAGCGTGACACTCCCCTCCGCGTCCCACGCCATCCCT

CAACTGACCACCAGCGGAACGGATTTTTGCATCGAGCTGGGTAATAAGCG

TTGGCAATTTAACCGCCAGTCAGGCTTTCTTTCACAGATGTGGATTGGCG

ATGAAAAACAACTGCTGACCCCGCTGCGCGATCAGTTCACCCGTGCGCCG

CTGGATAACGACATTGGCGTAAGTGAAGCGACCCGCATTGACCCTAACGC

CTGGGTCGAACGCTGGAAGGCGGCGGGCCATTACCAGGCCGAAGCGGCGT

TGTTGCAGTGCACGGCAGATACACTTGCCGACGCGGTGCTGATTACAACC

GCCCACGCGTGGCAGCATCAGGGGAAAACCTTATTTATCAGCCGGAAAAC

CTACCGGATTGATGGGCACGGTGAGATGGTCATCAATGTGGATGTTGCGG

TGGCAAGCGATACACCGCATCCGGCGCGGATTGGCCTGACCTGCCAGCTG

GCGCAGGTCTCAGAGCGGGTAAACTGGCTCGGCCTGGGGCCGCAAGAAAA

CTATCCCGACCGCCTTACTGCAGCCTGTTTTGACCGCTGGGATCTGCCAT

TGTCAGACATGTATACCCCGTACGTCTTCCCGAGCGAAAACGGTCTGCGC

TGCGGGACGCGCGAATTGAATTATGGCCCACACCAGTGGCGCGGCGACTT

CCAGTTCAACATCAGCCGCTACAGCCAACAACAACTGATGGAAACCAGCC

ATCGCCATCTGCTGCACGCGGAAGAAGGCACATGGCTGAATATCGACGGT

TTCCATATGGGGATTGGTGGCGACGACTCCTGGAGCCCGTCAGTATCGGC

GGAATTCCAGCTGAGCGCCGGTCGCTACCATTACCAGTTGGTCTGGTGTC

AAAAATAA

TABLE 74

Pfnr3-lacZ construct Sequences
Nucleotide sequences of Pfnr3-lacZ construct,
low-copy (SEQ ID NO: 242)

GGTACCgtcagcataacaccctgacctctcattaattgttcatgccgggc ggcactatcgtcgtccggccttttcctctcttactctgctacgtacatct atttctataaatccgttcaatttgtctgttttttgcacaaacatgaaata tcagacaattccgtgacttaagaaaatttatacaaatcagcaatataccc cttaaggagtatataaaggtgaatttgatttacatcaataagcggggttg ctgaatcgttaaGGATCCctctagaaataattttgtttaactttaagaag gagatatacatATGACTATGATTACGGATTCTCTGGCCGTCGTATTACAA

CGTCGTGACTGGGAAAACCCTGGCGTTACCCAACTTAATCGCCTTGCGGC

ACATCCCCCTTTCGCCAGCTGGCGTAATAGCGAAGAGGCCCGCACCGATC

GCCCTTCCCAACAGTTGCGCAGCCTGAATGGCGAATGGCGCTTTGCCTGG

TTTCCGGCACCAGAAGCGGTGCCGGAAAGCTGGCTGGAGTGCGATCTTCC

TGACGCCGATACTGTCGTCGTCCCCTCAAACTGGCAGATGCACGGTTACG

ATGCGCCTATCTACACCAACGTGACCTATCCCATTACGGTCAATCCGCCG

TTTGTTCCCGCGGAGAATCCGACAGGTTGTTACTCGCTCACATTTAATAT

TGATGAAAGCTGGCTACAGGAAGGCCAGACGCGAATTATTTTTGATGGCG

TTAACTCGGCGTTTCATCTGTGGTGCAACGGGCGCTGGGTCGGTTACGGC

CAGGACAGCCGTTTGCCGTCTGAATTTGACCTGAGCGCATTTTTACGCGC

CGGAGAAAACCGCCTCGCGGTGATGGTGCTGCGCTGGAGTGACGGCAGTT

ATCTGGAAGATCAGGATATGTGGCGGATGAGCGGCATTTTCCGTGACGTC

TCGTTGCTGCATAAACCGACCACGCAAATCAGCGATTTCCAAGTTACCAC

TCTCTTTAATGATGATTTCAGCCGCGCGGTACTGGAGGCAGAAGTTCAGA

TGTACGGCGAGCTGCGCGATGAACTGCGGGTGACGGTTTCTTTGTGGCAG

GGTGAAACGCAGGTCGCCAGCGGCACCGCGCCTTTCGGCGGTGAAATTAT

CGATGAGCGTGGCGGTTATGCCGATCGCGTCACACTACGCCTGAACGTTG

AAAATCCGGAACTGTGGAGCGCCGAAATCCCGAATCTCTATCGTGCAGTG

GTTGAACTGCACACCGCCGACGGCACGCTGATTGAAGCAGAAGCCTGCGA

CGTCGGTTTCCGCGAGGTGCGGATTGAAAATGGTCTGCTGCTGCTGAACG

GCAAGCCGTTGCTGATTCGCGGCGTTAACCGTCACGAGCATCATCCTCTG

CATGGTCAGGTCATGGATGAGCAGACGATGGTGCAGGATATCCTGCTGAT

GAAGCAGAACAACTTTAACGCCGTGCGCTGTTCGCATTATCCGAACCATC

CGCTGTGGTACACGCTGTGCGACCGCTACGGCCTGTATGTGGTGGATGAA

GCCAATATTGAAACCCACGGCATGGTGCCAATGAATCGTCTGACCGATGA

TCCGCGCTGGCTACCCGCGATGAGCGAACGCGTAACGCGGATGGTGCAGC

GCGATCGTAATCACCCGAGTGTGATCATCTGGTCGCTGGGGAATGAATCA

GGCCACGGCGCTAATCACGACGCGCTGTATCGCTGGATCAAATCTGTCGA

TCCTTCCCGCCCGGTACAGTATGAAGGCGGCGGAGCCGACACCACGGCCA

CCGATATTATTTGCCCGATGTACGCGCGCGTGGATGAAGACCAGCCCTTC

CCGGCGGTGCCGAAATGGTCCATCAAAAAATGGCTTTCGCTGCCTGGAGA

TABLE 74-continued

Pfnr3-lacZ construct Sequences
Nucleotide sequences of Pfnr3-lacZ construct,
low-copy (SEQ ID NO: 242)

AATGCGCCCGCTGATCCTTTGCGAATATGCCCACGCGATGGGTAACAGTC

TTGGCGGCTTCGCTAAATACTGGCAGGCGTTTCGTCAGTACCCCCGTTTA

CAGGGCGGCTTCGTCTGGGACTGGGTGGATCAGTCGCTGATTAAATATGA

TGAAAACGGCAACCCGTGGTCGGCTTACGGCGGTGATTTTGGCGATACGC

CGAACGATCGCCAGTTCTGTATGAACGGTCTGGTCTTTGCCGACCGCACG

CCGCATCCGGCGCTGACGGAAGCAAAACACCAACAGCAGTATTTCCAGTT

CCGTTTATCCGGGCGAACCATCGAAGTGACCAGCGAATACCTGTTCCGTC

ATAGCGATAACGAGTTCCTGCACTGGATGGTGGCACTGGATGGCAAGCCG

CTGGCAAGCGGTGAAGTGCCTCTGGATGTTGGCCCGCAAGGTAAGCAGTT

GATTGAACTGCCTGAACTGCCGCAGCCGGAGAGCGCCGGACAACTCTGGC

TAACGGTACGCGTAGTGCAACCAAACGCGACCGCATGGTCAGAAGCCGGA

CACATCAGCGCCTGGCAGCAATGGCGTCTGGCGGAAAACCTCAGCGTGAC

ACTCCCCTCCGCGTCCCACGCCATCCCTCAACTGACCACCAGCGGAACGG

ATTTTTGCATCGAGCTGGGTAATAAGCGTTGGCAATTTAACCGCCAGTCA

GGCTTTCTTTCACAGATGTGGATTGGCGATGAAAAACAACTGCTGACCCC

GCTGCGCGATCAGTTCACCCGTGCGCCGCTGGATAACGACATTGGCGTAA

GTGAAGCGACCCGCATTGACCCTAACGCCTGGGTCGAACGCTGGAAGGCG

GCGGGCCATTACCAGGCCGAAGCGGCGTTGTTGCAGTGCACGGCAGATAC

ACTTGCCGACGCGGTGCTGATTACAACCGCCCACGCGTGGCAGCATCAGG

GGAAAACCTTATTTATCAGCCGGAAAACCTACCGGATTGATGGGCACGGT

GAGATGGTCATCAATGTGGATGTTGCGGTGGCAAGCGATACACCGCATCC

GGCGCGGATTGGCCTGACCTGCCAGCTGGCGCAGGTCTCAGAGCGGGTAA

ACTGGCTCGGCCTGGGGCCGCAAGAAAACTATCCCGACCGCCTTACTGCA

GCCTGTTTTGACCGCTGGGATCTGCCATTGTCAGACATGTATACCCCGTA

CGTCTTCCCGAGCGAAAACGGTCTGCGCTGCGGGACGCGCGAATTGAATT

ATGGCCCACACCAGTGGCGCGGCGACTTCCAGTTCAACATCAGCCGCTAC

AGCCAACAACAACTGATGGAAACCAGCCATCGCCATCTGCTGCACGCGGA

AGAAGGCACATGGCTGAATATCGACGGTTTCCATATGGGGATTGGTGGCG

ACGACTCCTGGAGCCCGTCAGTATCGGCGGAATTCCAGCTGAGCGCCGGT

CGCTACCATTACCAGTTGGTCTGGTGTCAAAAATAA

TABLE 75

Pfnr4-lacZ construct Sequences
Nucleotide sequences of Pfnr4-lacZ construct,
low-copy (SEQ ID NO: 243)

GGTACCcattcctctcatccatccggggtgagagtcttttccccgac ttatggctcatgcatgcatcaaaaaagatgtgagcttgatcaaaaacaaa aaatatttcactcgacaggagtatttatattgcgcccGGATCCctctaga aataattttgtttaactttaagaaggagatatacatATGACTATGATTAC TABLE 75-continued Pfnr4-lacZ construct Sequences
Nucleotide sequences of Pfnr4-lacZ construct,
low-copy (SEQ ID NO: 243)

GGATTCTCTGGCCGTCGTATTACAACGTCGTGACTGGGAAAACCCTGGCG

TTACCCAACTTAATCGCCTTGCGGCACATCCCCCTTTCGCCAGCTGGCGT

AATAGCGAAGAGGCCCGCACCGATCGCCCTTCCCAACAGTTGCGCAGCCT

GAATGGCGAATGGCGCTTTGCCTGGTTTCCGGCACCAGAAGCGGTGCCGG

AAAGCTGGCTGGAGTGCGATCTTCCTGACGCCGATACTGTCGTCGTCCCC

TCAAACTGGCAGATGCACGGTTACGATGCGCCTATCTACACCAACGTGAC

CTATCCCATTACGGTCAATCCGCCGTTTGTTCCCGCGGAGAATCCGACAG

GTTGTTACTCGCTCACATTTAATATTGATGAAAGCTGGCTACAGGAAGGC

CAGACGCGAATTATTTTTGATGGCGTTAACTCGGCGTTTCATCTGTGGTG

CAACGGGCGCTGGGTCGGTTACGGCCAGGACAGCCGTTTGCCGTCTGAAT

TTGACCTGAGCGCATTTTTACGCGCCGGAGAAAACCGCCTCGCGGTGATG

GTGCTGCGCTGGAGTGACGGCAGTTATCTGGAAGATCAGGATATGTGGCG

GATGAGCGGCATTTTCCGTGACGTCTCGTTGCTGCATAAACCGACCACGC

AAATCAGCGATTTCCAAGTTACCACTCTCTTTAATGATGATTTCAGCCGC

GCGGTACTGGAGGCAGAAGTTCAGATGTACGGCGAGCTGCGCGATGAACT

GCGGGTGACGGTTTCTTTGTGGCAGGGTGAAACGCAGGTCGCCAGCGGCA

CCGCGCCTTTCGGCGGTGAAATTATCGATGAGCGTGGCGGTTATGCCGAT

CGCGTCACACTACGCCTGAACGTTGAAAATCCGGAACTGTGGAGCGCCGA

AATCCCGAATCTCTATCGTGCAGTGGTTGAACTGCACACCGCCGACGGCA

CGCTGATTGAAGCAGAAGCCTGCGACGTCGGTTTCCGCGAGGTGCGGATT

GAAAATGGTCTGCTGCTGCTGAACGGCAAGCCGTTGCTGATTCGCGGCGT

TAACCGTCACGAGCATCATCCTCTGCATGGTCAGGTCATGGATGAGCAGA

CGATGGTGCAGGATATCCTGCTGATGAAGCAGAACAACTTTAACGCCGTG

CGCTGTTCGCATTATCCGAACCATCCGCTGTGGTACACGCTGTGCGACCG

CTACGGCCTGTATGTGGTGGATGAAGCCAATATTGAAACCCACGGCATGG

TGCCAATGAATCGTCTGACCGATGATCCGCGCTGGCTACCCGCGATGAGC

GAACGCGTAACGCGGATGGTGCAGCGCGATCGTAATCACCCGAGTGTGAT

CATCTGGTCGCTGGGGAATGAATCAGGCCACGGCGCTAATCACGACGCGC

TGTATCGCTGGATCAAATCTGTCGATCCTTCCCGCCCGGTACAGTATGAA

GGCGGCGGAGCCGACACCACGGCCACCGATATTATTTGCCCGATGTACGC

GCGCGTGGATGAAGACCAGCCCTTCCCGGCGGTGCCGAAATGGTCCATCA

AAAAATGGCTTTCGCTGCCTGGAGAAATGCGCCCGCTGATCCTTTGCGAA

TATGCCCACGCGATGGGTAACAGTCTTGGCGGCTTCGCTAAATACTGGCA

GGCGTTTCGTCAGTACCCCCGTTTACAGGGCGGCTTCGTCTGGGACTGGG

TGGATCAGTCGCTGATTAAATATGATGAAAACGGCAACCCGTGGTCGGCT

TACGGCGGTGATTTTGGCGATACGCCGAACGATCGCCAGTTCTGTATGAA

CGGTCTGGTCTTTGCCGACCGCACGCCGCATCCGGCGCTGACGGAAGCAA

AACACCAACAGCAGTATTTCCAGTTCCGTTTATCCGGGCGAACCATCGAA

TABLE 75-continued

Pfnr4-lacZ construct Sequences
Nucleotide sequences of Pfnr4-lacZ construct,
low-copy (SEQ ID NO: 243)

GTGACCAGCGAATACCTGTTCCGTCATAGCGATAACGAGTTCCTGCACTG

GATGGTGGCACTGGATGGCAAGCCGCTGGCAAGCGGTGAAGTGCCTCTGG

ATGTTGGCCCGCAAGGTAAGCAGTTGATTGAACTGCCTGAACTGCCGCAG

CCGGAGAGCGCCGGACAACTCTGGCTAACGGTACGCGTAGTGCAACCAAA

CGCGACCGCATGGTCAGAAGCCGGACACATCAGCGCCTGGCAGCAATGGC

GTCTGGCGGAAAACCTCAGCGTGACACTCCCCTCCGCGTCCCACGCCATC

CCTCAACTGACCACCAGCGGAACGGATTTTTGCATCGAGCTGGGTAATAA

GCGTTGGCAATTTAACCGCCAGTCAGGCTTTCTTTCACAGATGTGGATTG

GCGATGAAAAACAACTGCTGACCCCGCTGCGCGATCAGTTCACCCGTGCG

CCGCTGGATAACGACATTGGCGTAAGTGAAGCGACCCGCATTGACCCTAA

CGCCTGGGTCGAACGCTGGAAGGCGGCGGGCCATTACCAGGCCGAAGCGG

CGTTGTTGCAGTGCACGGCAGATACACTTGCCGACGCGGTGCTGATTACA

ACCGCCCACGCGTGGCAGCATCAGGGGAAAACCTTATTTATCAGCCGGAA

AACCTACCGGATTGATGGGCACGGTGAGATGGTCATCAATGTGGATGTTG

CGGTGGCAAGCGATACACCGCATCCGGCGCGGATTGGCCTGACCTGCCAG

CTGGCGCAGGTCTCAGAGCGGGTAAACTGGCTCGGCCTGGGGCCGCAAGA

AAACTATCCCGACCGCCTTACTGCAGCCTGTTTTGACCGCTGGGATCTGC

CATTGTCAGACATGTATACCCCGTACGTCTTCCCGAGCGAAAACGGTCTG

CGCTGCGGGACGCGCGAATTGAATTATGGCCCACACCAGTGGCGCGGCGA

CTTCCAGTTCAACATCAGCCGCTACAGCCAACAACAACTGATGGAAACCA

GCCATCGCCATCTGCTGCACGCGGAAGAAGGCACATGGCTGAATATCGAC

GGTTTCCATATGGGGATTGGTGGCGACGACTCCTGGAGCCCGTCAGTATC

GGCGGAATTCCAGCTGAGCGCCGGTCGCTACCATTACCAGTTGGTCTGGT

GTCAAAAATAA

TABLE 76

Pfnrs-lacZ construct Sequences
Nucleotide sequences of Pfnrs-lacZ construct,
low-copy (SEQ ID NO: 244)

GGTACCagttgttcttattggtggtgttgctttatggttgcatcgtagta aatggttgtaacaaaagcaattttccggctgtctgtatacaaaaacgcc gtaaagtttgagcgaagtcaataaactctctacccattcagggcaatatc tctcttGGATCCctctagaaataattttgtttaactttaagaaggagata tacatATGCTATGATTACGGATTCTCTGGCCGTCGTATTACAACGTCGTG

ACTGGGAAAACCCTGGCGTTACCCAACTTAATCGCCTTGCGGCACATCCC

CCTTTCGCCAGCTGGCGTAATAGCGAAGAGGCCCGCACCGATCGCCCTTC

CCAACGTTGCGCAGCCTGAATGGCGAATGGCGCTTTGCCTGGTTTCCGG

CACCAGAAGCGGTGCCGGAAAGCTGGCTGGAGTGCGATCTTCCTGACGCC

TABLE 76-continued

Pfnrs-lacZ construct Sequences
Nucleotide sequences of Pfnrs-lacZ construct,
low-copy (SEQ ID NO: 244)

GATACTGTCGTCGTCCCCTCAAACTGGCAGATGCACGGTTACGATGCGCC

TATCTACACCAACGTGACCTATCCCATTACGGTCAATCCGCCGTTTGTTC

CCGCGGAGAATCCGACAGGTTGTTACTCGCTCACATTTAATATTGATGAA

AGCTGGCTACAGGAAGGCCAGACGCGAATTATTTTTGATGGCGTTAACTC

GGCGTTTCATCTGTGGTGCAACGGGCGCTGGGTCGGTTACGGCCAGGACA

GCCGTTTGCCGTCTGAATTTGACCTGAGCGCATTTTTACGCGCCGGAGAA

AACCGCCTCGCGGTGATGGTGCTGCGCTGGAGTGACGGCAGTTATCTGGA

AGATCAGGATATGTGGCGGATGAGCGGCATTTTCCGTGACGTCTCGTTGC

TGCATAAACCGACCACGCAAATCAGCGATTTCCAAGTTACCACTCTCTTT

AATGATGATTTCAGCCGCGCGGTACTGGAGGCAGAAGTTCAGATGTACGG

CGAGCTGCGCGATGAACTGCGGGTGACGGTTTCTTTGTGGCAGGGTGAAA

CGCAGGTCGCCAGCGGCACCGCGCCTTTCGGCGGTGAAATTATCGATGAG

CGTGGCGGTTATGCCGATCGCGTCACACTACGCCTGAACGTTGAAAATCC

GGAACTGTGGAGCGCCGAAATCCCGAATCTCTATCGTGCAGTGGTTGAAC

TGCACACCGCCGACGGCACGCTGATTGAAGCAGAAGCCTGCGACGTCGGT

TTCCGCGAGGTGCGGATTGAAAATGGTCTGCTGCTGCTGAACGGCAAGCC

GTTGCTGATTCGCGGCGTTAACCGTCACGAGCATCATCCTCTGCATGGTC

AGGTCATGGATGAGCAGACGATGGTGCAGGATATCCTGCTGATGAAGCAG

AACAACTTTAACGCCGTGCGCTGTTCGCATTATCCGAACCATCCGCTGTG

GTACACGCTGTGCGACCGCTACGGCCTGTATGTGGTGGATGAAGCCAATA

TTGAAACCCACGGCATGGTGCCAATGAATCGTCTGACCGATGATCCGCGC

TGGCTACCCGCGATGAGCGAACGCGTAACGCGGATGGTGCAGCGCGATCG

TAATCACCCGAGTGTGATCATCTGGTCGCTGGGGAATGAATCAGGCCACG

GCGCTAATCACGACGCGCTGTATCGCTGGATCAAATCTGTCGATCCTTCC

CGCCCCGGTACAGTATGAAGGCGGCGGAGCCGACACCACGGCCACCGATAT

TATTTGCCCGATGTACGCGCGCGTGGATGAAGACCAGCCCTTCCCGGCGG

TGCCGAAATGGTCCATCAAAAAATGGCTTTCGCTGCCTGGAGAAATGCGC

CCGCTGATCCTTTGCGAATATGCCCACGCGATGGGTAACAGTCTTGGCGG

CTTCGCTAAATACTGGCAGGCGTTTCGTCAGTACCCCCGTTTACAGGGCG

GCTTCGTCTGGGACTGGGTGGATCAGTCGCTGATTAAATATGATGAAAAC

GGCAACCCGTGGTCGGCTTACGGCGGTGATTTTGGCGATACGCCGAACGA

TCGCCAGTTCTGTATGAACGGTCTGGTCTTTGCCGACCGCACGCCGCATC

CGGCGCTGACGGAAGCAAAACACCAACAGCAGTATTTCCAGTTCCGTTTA

TCCGGGCGAACCATCGAAGTGACCAGCGAATACCTGTTCCGTCATAGCGA

TAACGAGTTCCTGCACTGGATGGTGGCACTGGATGGCAAGCCGCTGGCAA

GCGGTGAAGTGCCTCTGGATGTTGGCCCGCAAGGTAAGCAGTTGATTGAA

CTGCCTGAACTGCCGCAGCCGGAGAGCGCCGGACAACTCTGGCTAACGGT

ACGCGTAGTGCAACCAAACGCGACCGCATGGTCAGAAGCCGGACACATCA

TABLE 76-continued

Pfnrs-lacZ construct Sequences
Nucleotide sequences of Pfnrs-lacZ construct,
low-copy (SEQ ID NO: 244)

GCGCCTGGCAGCAATGGCGTCTGGCGGAAAACCTCAGCGTGACACTCCCC

TCCGCGTCCCACGCCATCCCTCAACTGACCACCAGCGGAACGGATTTTTG

CATCGAGCTGGGTAATAAGCGTTGGCAATTTAACCGCCAGTCAGGCTTTC

TTTCACAGATGTGGATTGGCGATGAAAAACAACTGCTGACCCCGCTGCGC

GATCAGTTCACCCGTGCGCCGCTGGATAACGACATTGGCGTAAGTGAAGC

GACCCGCATTGACCCTAACGCCTGGGTCGAACGCTGGAAGGCGGCGGGCC

ATTACCAGGCCGAAGCGGCGTTGTTGCAGTGCACGGCAGATACACTTGCC

GACGCGGTGCTGATTACAACCGCCCACGCGTGGCAGCATCAGGGGAAAAC

CTTATTTATCAGCCGGAAAACCTACCGGATTGATGGGCACGGTGAGATGG

TCATCAATGTGGATGTTGCGGTGGCAAGCGATACACCGCATCCGGCGCGG

ATTGGCCTGACCTGCCAGCTGGCGCAGGTCTCAGAGCGGGTAAACTGGCT

CGGCCTGGGGCCGCAAGAAAACTATCCCGACCGCCTTACTGCAGCCTGTT

TTGACCGCTGGGATCTGCCATTGTCAGACATGTATACCCCGTACGTCTTC

CCGAGCGAAAACGGTCTGCGCTGCGGGACGCGCGAATTGAATTATGGCCC

ACACCAGTGGCGCGGCGACTTCCAGTTCAACATCAGCCGCTACAGCCAAC

AACAACTGATGGAAACCAGCCATCGCCATCTGCTGCACGCGGAAGAAGGC

ACATGGCTGAATATCGACGGTTTCCATATGGGGATTGGTGGCGACGACTC

CTGGAGCCCGTCAGTATCGGCGGAATTCCAGCTGAGCGCCGGTCGCTACC

ATTACCAGTTGGTCTGGTGTCAAAAATAA

Example 32

Nitric Oxide-Inducible Reporter Constructs

ATC and nitric oxide-inducible reporter constructs were synthesized (Genewiz, Cambridge, Mass.). When induced by their cognate inducers, these constructs express GFP, which is detected by monitoring fluorescence in a plate reader at an excitation/emission of 395/509 nm, respectively. Nissle cells harboring plasmids with either the control, ATC-inducible Ptet-GFP reporter construct, or the nitric oxide inducible PnsrR-GFP reporter construct were first grown to early log phase (OD600 of about 0.4-0.6), at which point they were transferred to 96-well microtiter plates containing LB and two-fold decreased inducer (ATC or the long half-life NO donor, DETA-NO (Sigma)). Both ATC and NO were able to induce the expression of GFP in their respective constructs across a range of concentrations (FIG. 28); promoter activity is expressed as relative florescence units. An exemplary sequence of a nitric oxide-inducible reporter construct is shown. The bsrR sequence is bolded. The gfp sequence is underlined. The PnsrR (NO regulated promoter and RBS) is italicized. The constitutive promoter and RBS are boxed.

TABLE 77

SEQ ID NO: 245

SEQ ID NO: 245
ttattatcgcaccgcaatcgggattttcgattcataaagcaggtcgtaggtcggcttgtt gagcaggtcttgcagcgtgaaaccgtccagatacgtgaaaaacgacttcattgcaccgcc gagtatgcccgtcagccggcaggacggcgtaatcaggcattcgttgttcgggcccataca ctcgaccagctgcatcggttcgaggtggcggacgaccgcgccgatattgatgcgttcggg cggcgcggccagcctcagcccgccgcctttcccgcgtacgctgtgcaagaacccgcctt gaccagcgcggtaaccactttcatcaaatggcttttggaaatgccgtaggtcgaggcgat ggtggcgatattgaccagcgcgtcgtcgttgacggcggtgtagatgaggacgcgcagccc gtagtcggtatgttgggtcagatacat acaacctccttagtacatgcaaaattatttcta gagcaacatacgagccggaagcataaagtgtaaagcctggggtgcctaatgagttgagtt gaggaattataacaggaagaaatattcctcatacgcttgtaattcctctatggttg tga caattaatcatcggctcgtataatgtataacattcatattttgtgaattttaaactctag aaataattttgtttaactttaagaaggagatatacata tggctagcaaaggcgaagaatt gttcacgggcgttgttcctatttggttgaattggatggcgatgttaatggccataaatt cagcgttagcggcgaaggcgaaggcgatgctacgtatggcaaattgacgttgaaattcat ttgtacgacgggcaaattgcctgttccttggcctacgttggttacgacgttcagctatgg cgttcaatgtttcagccgttatcctgatcatatgaaacgtcatgatttcttcaaaagcgc tatgcctgaaggctatgttcaagaacgtacgattagcttcaaagatgatggcaattataa TABLE 77-continued

SEQ ID NO: 245 aacgcgtgctgaagttaaattcgaaggcgatacgttggttaatcgtattgaattgaaagg cattgatttcaaagaagatggcaatatttttgggccataaattggaatataattataatag ccataatgtttatattacggctgataaacaaaaaaatggcattaaagctaatttcaaaat tcgtcataatattgaagatggcagcgttcaattggctgatcattatcaacaaaatacgcc tattggcgatggccctgttttgttgcctgataatcattatttgagcacgcaaagcgcttt gagcaaagatcctaatgaaaaacgtgatcatatggttttgttggaattcgttacggctgc tggcattacgcatggcatggatgaattgtataaataataa These constructs, when induced by their cognate inducer, lead to high level expression of GFP, which is detected by monitoring fluorescence in a plate reader at an excitation/emission of 395/509 nm, respectively. Nissle cells harboring plasmids with either the ATC-inducible Ptet-GFP reporter construct or the nitric oxide inducible PnsrR-GFP reporter construct were first grown to early log phase (OD600=~0.4-0.6), at which point they were transferred to 96-well microtiter plates containing LB and 2-fold decreases in inducer (ATC or the long half-life NO donor, DETA-NO (Sigma)). It was observed that both the ATC and NO were able to induce the expression of GFP in their respective construct across a wide range of concentrations. Promoter activity is expressed as relative florescence units.

Figure 63A:
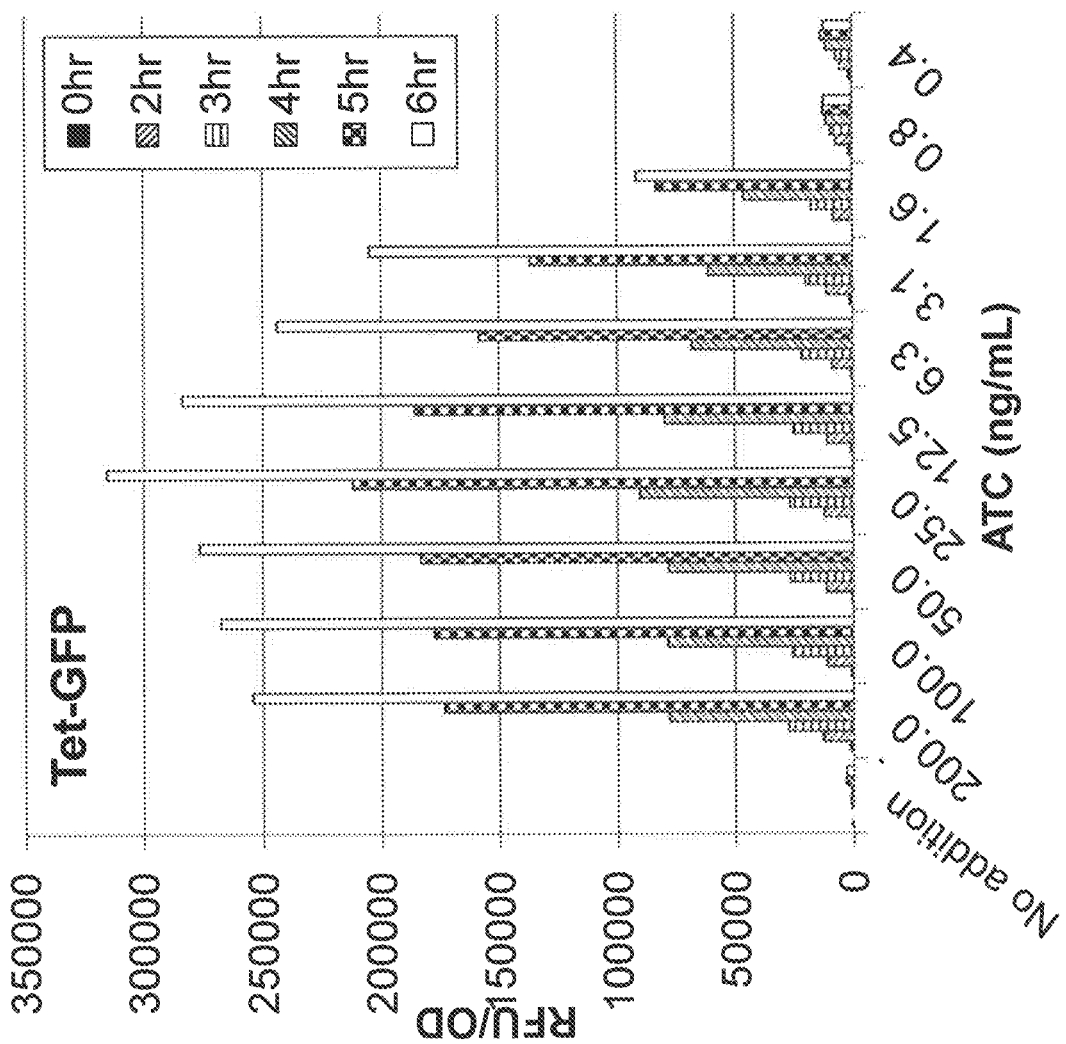
FIGS. 63A-63D depict bar graphs, schematic, and dot blot, respectively, showing the structure or activity of reporter constructs.
Figure 63B:
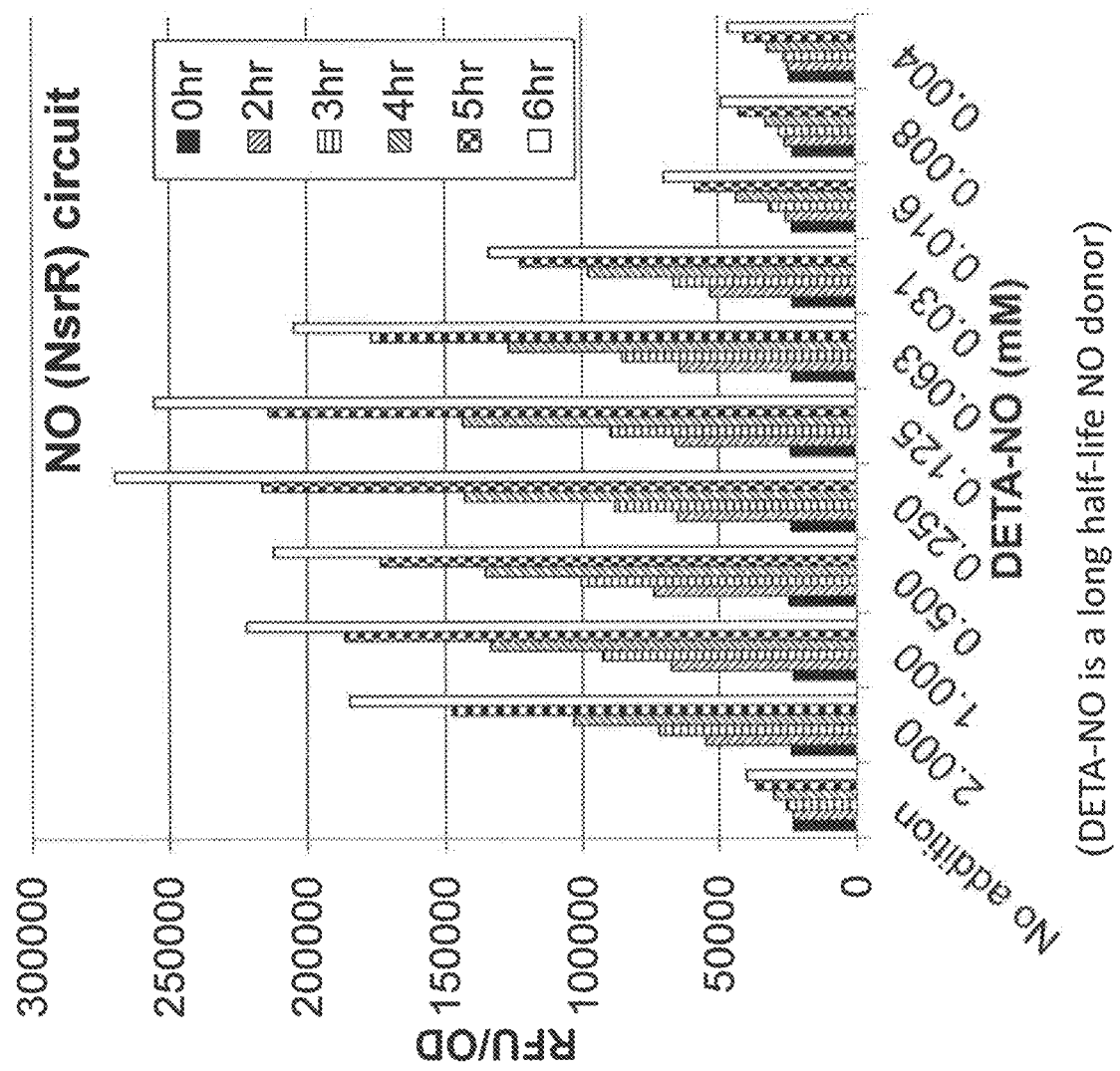
Figure 63C:
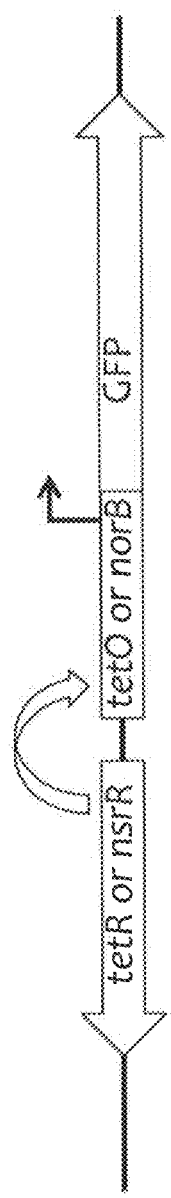
Figure 63D:
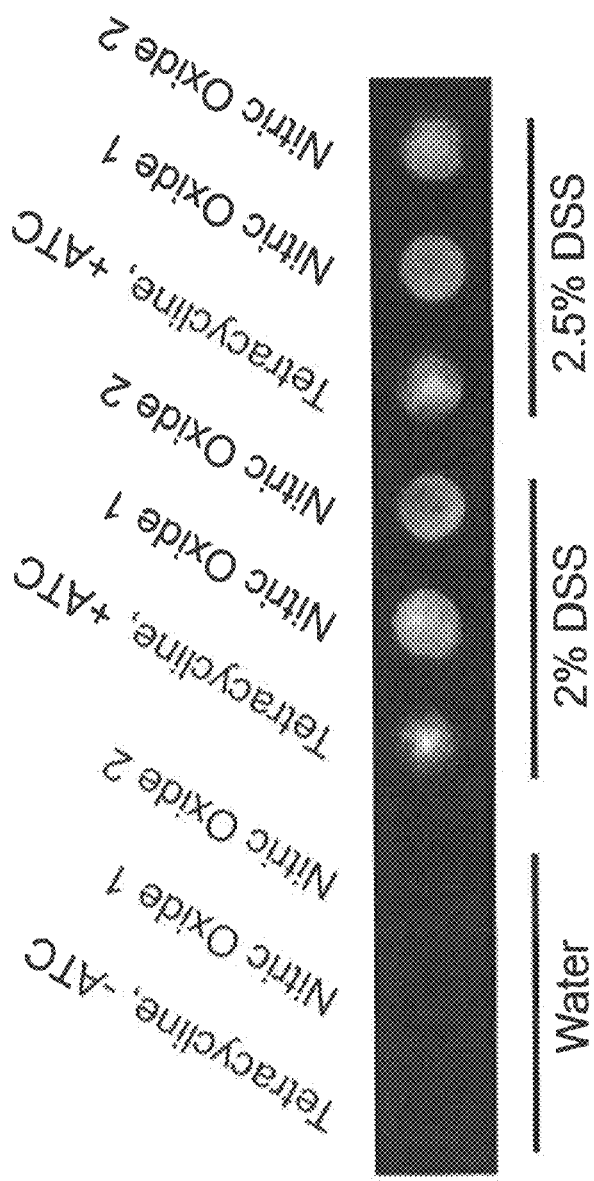

FIG. 63D NO-GFP constructs (the dot blot) *E. coli* Nissle harboring the nitric oxide inducible NsrR-GFP reporter fusion were grown overnight in LB supplemented with kanamycin. Bacteria were then diluted 1:100 into LB containing kanamycin and grown to an optical density of 0.4-0.5 and then pelleted by centrifugation. Bacteria were resuspended in phosphate buffered saline and 100 microliters were administered by oral gavage to mice. IBD is induced in mice by supplementing drinking water with 2-3% dextran sodium sulfate for 7 days prior to bacterial gavage. At 4 hours post-gavage, mice were sacrificed and bacteria were recovered from colonic samples. Colonic contents were boiled in SDS, and the soluble fractions were used to perform a dot blot for GFP detection (induction of NsrR-regulated promoters). Detection of GFP was performed by binding of anti-GFP antibody conjugated to HRP (horse radish peroxidase). Detection was visualized using Pierce chemiluminescent detection kit. It is shown in the figure that NsrR-regulated promoters are induced in DSS-treated mice, but are not shown to be induced in untreated mice. This is consistent with the role of NsrR in response to NO, and thus inflammation.

Bacteria harboring a plasmid expressing NsrR under control of a constitutive promoter and the reporter gene gfp (green fluorescent protein) under control of an NsrR-inducible promoter were grown overnight in LB supplemented with kanamycin. Bacteria are then diluted 1:100 into LB containing kanamycin and grown to an optical density of about 0.4-0.5 and then pelleted by centrifugation. Bacteria are resuspended in phosphate buffered saline and 100 microliters were administered by oral gavage to mice. IBD is induced in mice by supplementing drinking water with 2-3% dextran sodium sulfate for 7 days prior to bacterial gavage. At 4 hours post-gavage, mice were sacrificed and bacteria were recovered from colonic samples. Colonic contents were boiled in SDS, and the soluble fractions were used to perform a dot blot for GFP detection (induction of NsrR-regulated promoters) Detection of GFP was performed by binding of anti-GFP antibody conjugated to HRP (horse radish peroxidase). Detection was visualized using Pierce chemiluminescent detection kit. FIG. 15 shows NsrR-regulated promoters are induced in DSS-treated mice, but not in untreated mice.

Example 33

Generation of ΔThyA

An auxotrophic mutation causes bacteria to die in the absence of an exogenously added nutrient essential for survival or growth because they lack the gene(s) necessary to produce that essential nutrient. In order to generate genetically engineered bacteria with an auxotrophic modification, the thyA, a gene essential for oligonucleotide synthesis was deleted. Deletion of the thyA gene in *E. coli* Nissle yields a strain that cannot form a colony on LB plates unless they are supplemented with thymidine.

A thyA::cam PCR fragment was amplified using 3 rounds of PCR as follows. Sequences of the primers used at a 100 um concentration are found in Table 78.

TABLE 78

Primer Sequences

| Name | Sequence | Description | SEQ ID NO |
|---|---|---|---|
| SR36 | tagaactgatgcaaaaagtgctcgacgaaggcacacagaTGTGTAGG CTGGAGCTGCTTC | Round 1: binds on pKD3 | SEQ ID NO: 246 |
| SR38 | gtttcgtaattagatagccaccggcgctttaatgcccggaCATATGAAT ATCCTCCTTAG | Round 1: binds on pKD3 | SEQ ID NO: 247 |

TABLE 78-continued

Primer Sequences

| Name | Sequence | Description | SEQ ID NO |
|---|---|---|---|
| SR33 | caacacgtttcctgaggaaccatgaaacagtatttagaactgatgcaaaaag | Round 2: binds to round 1 PCR product | SEQ ID NO: 248 |
| SR34 | cgcacactggcgtcggctctggcaggatgtttcgtaattagatagc | Round 2: binds to round 1 PCR product | SEQ ID NO: 249 |
| SR43 | atatcgtcgcagcccacagcaacacgtttcctgagg | Round 3: binds to round 2 PCR product | SEQ ID NO: 250 |
| SR44 | aagaatttaacggagggcaaaaaaaaccgacgcacactggcgtcggc | Round 3: binds to round 2 PCR product | SEQ ID NO: 251 |

For the first PCR round, 4×50 ul PCR reactions containing 1ng pKD3 as template, 25 ul 2×phusion, 0.2 ul primer SR36 and SR38, and either 0, 0.2, 0.4 or 0.6 ul DMSO were brought up to 50 ul volume with nuclease free water and amplified under the following cycle conditions:

step1: 98 c for 30 s
step2: 98 c for 10 s
step3: 55 c for 15 s
step4: 72 c for 20 s
repeat step 2-4 for 30 cycles
step5: 72 c for 5 min Subsequently, 5 ul of each PCR reaction was run on an agarose gel to confirm PCR product of the appropriate size. The PCR product was purified from the remaining PCR reaction using a Zymoclean gel DNA recovery kit according to the manufacturer's instructions and eluted in 30 ul nuclease free water.

For the second round of PCR, 1 ul purified PCR product from round 1 was used as template, in 4×50 ul PCR reactions as described above except with 0.2 ul of primers SR33 and SR34. Cycle conditions were the same as noted above for the first PCR reaction. The PCR product run on an agarose gel to verify amplification, purified, and eluted in 30 ul as described above.

For the third round of PCR, 1 ul of purified PCR product from round 2 was used as template in 4×50 ul PCR reactions as described except with primer SR43 and SR44. Cycle conditions were the same as described for rounds 1 and 2. Amplification was verified, the PCR product purified, and eluted as described above. The concentration and purity was measured using a spectrophotometer. The resulting linear DNA fragment, which contains 92 bp homologous to upstream of thyA, the chloramphenicol cassette flanked by frt sites, and 98 bp homologous to downstream of the thyA gene, was transformed into a E. coli Nissle 1917 strain containing pKD46 grown for recombineering. Following electroporation, 1 ml SOC medium containing 3 mM thymidine was added, and cells were allowed to recover at 37 C for 2 h with shaking. Cells were then pelleted at 10,000×g for 1 minute, the supernatant was discarded, and the cell pellet was resuspended in 100 ul LB containing 3 mM thymidine and spread on LB agar plates containing 3 mM thy and 20 ug/ml chloramphenicol. Cells were incubated at 37 C overnight. Colonies that appeared on LB plates were restreaked. +cam 20 ug/ml+ or −thy 3 mM. (thyA auxotrophs will only grow in media supplemented with thy 3 mM).

Next, the antibiotic resistance was removed with pCP20 transformation. pCP20 has the yeast Flp recombinase gene, FLP, chloramphenicol and ampicillin resistant genes, and temperature sensitive replication. Bacteria were grown in LB media containing the selecting antibiotic at 37° C. until OD600=0.4-0.6. 1 mL of cells were washed as follows: cells were pelleted at 16,000×g for 1 minute. The supernatant was discarded and the pellet was resuspended in 1 mL ice-cold 10% glycerol. This wash step was repeated 3× times. The final pellet was resuspended in 70 ul ice-cold 10% glycerol. Next, cells were electroporated with 1 ng pCP20 plasmid DNA, and 1 mL SOC supplemented with 3 mM thymidine was immediately added to the cuvette. Cells were resuspended and transferred to a culture tube and grown at 30° C. for 1 hours. Cells were then pelleted at 10,000×g for 1 minute, the supernatant was discarded, and the cell pellet was resuspended in 100 ul LB containing 3 mM thymidine and spread on LB agar plates containing 3 mM thy and 100 ug/ml carbenicillin and grown at 30° C. for 16-24 hours. Next, transformants were colony purified non-selectively (no antibiotics) at 42° C.

To test the colony-purified transformants, a colony was picked from the 42° C. plate with a pipette tip and resuspended in 10 μL LB. 3 μL of the cell suspension was pipetted onto a set of 3 plates: Cam, (37° C.; tests for the presence/absence of CamR gene in the genome of the host strain), Amp, (30° C., tests for the presence/absence of AmpR from the pCP20 plasmid) and LB only (desired cells that have lost the chloramphenicol cassette and the pCP20 plasmid), 37° C. Colonies were considered cured if there is no growth in neither the Cam or Amp plate, picked, and re-streaked on an LB plate to get single colonies, and grown overnight at 37° C.

Example 34

Nissle Residence

Unmodified E. coli Nissle and the genetically engineered bacteria of the invention may be destroyed, e.g., by defense factors in the gut or blood serum. The residence time of bacteria in vivo may be calculated. A non-limiting example using a streptomycin-resistant strain of E. coli Nissle is described below. In alternate embodiments, residence time is calculated for the genetically engineered bacteria of the invention.

C57BL/6 mice were acclimated in the animal facility for 1 week. After one week of acclimation (i.e., day 0), streptomycin-resistant Nissle (SYN-UCD103) was administered to the mice via oral gavage on days 1-3. Mice were not pre-treated with antibiotic. The amount of bacteria administered, i.e., the inoculant, is shown in Table 79. In order to determine the CFU of the inoculant, the inoculant was serially diluted, and plated onto LB plates containing streptomycin (300 µg/mL). The plates were incubated at 37° C. overnight, and colonies were counted.

TABLE 79

| CFU administered via oral gavage CFU administered via oral gavage | | | |
|---|---|---|---|
| Strain | Day 1 | Day 2 | Day 3 |
| SYN-UCD103 | 1.30E+08 | 8.50E+08 | 1.90E+09 |

On days 2-10, fecal pellets were collected from up to 6 mice (ID NOs. 1-6; Table 80). The pellets were weighed in tubes containing PBS and homogenized. In order to determine the CFU of Nissle in the fecal pellet, the homogenized fecal pellet was serially diluted, and plated onto LB plates containing streptomycin (300 µg/mL). The plates were incubated at 37° C. overnight, and colonies were counted.

Fecal pellets from day 1 were also collected and plated on LB plates containing streptomycin (300 µg/mL) to determine if there were any strains native to the mouse gastrointestinal tract that were streptomycin resistant. The time course and amount of administered Nissle still residing within the mouse gastrointestinal tract is shown in Table 80.

Figure 64:
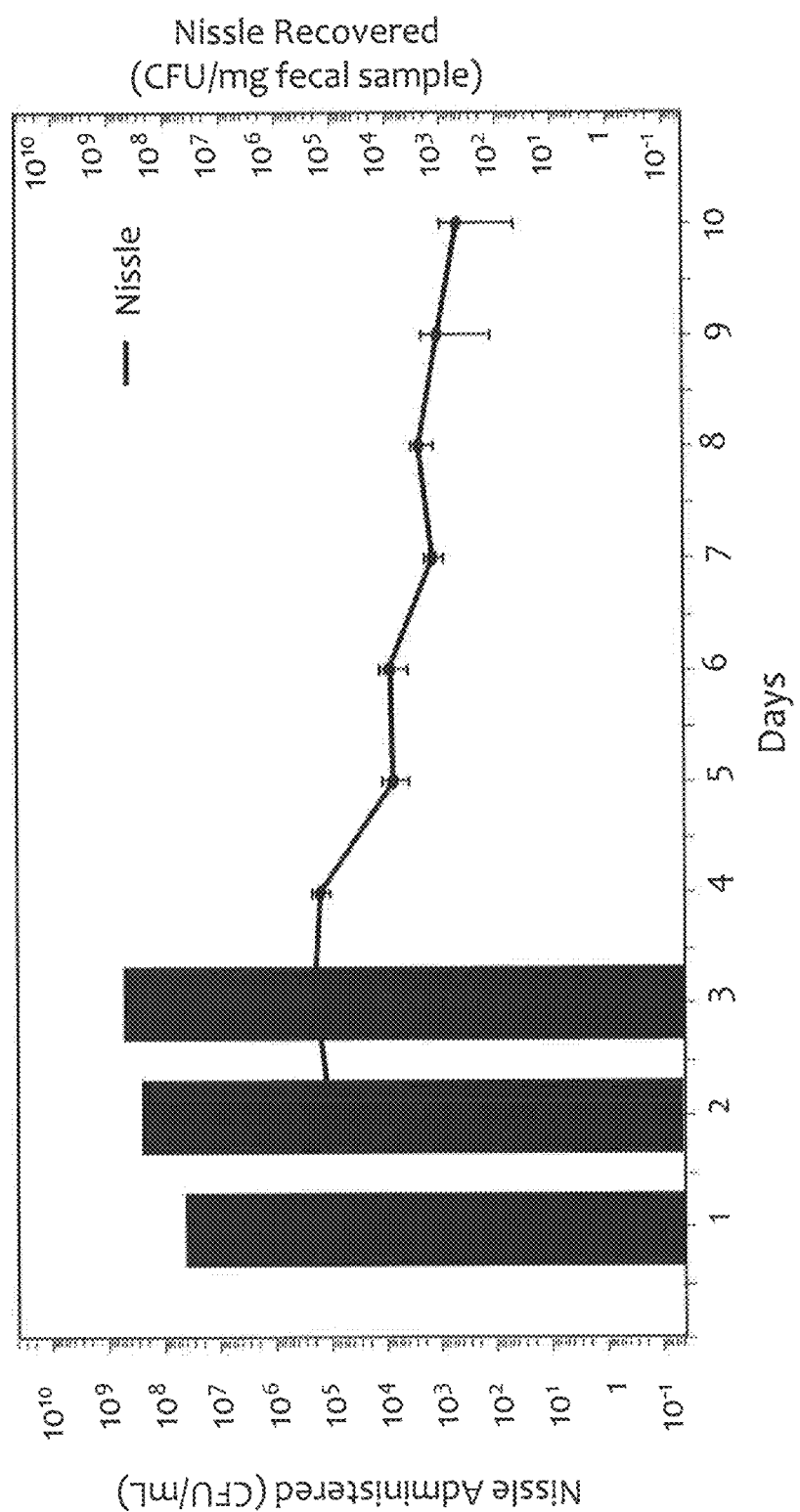
FIG. 64 depicts a graph of Nissle residence in vivo. Streptomycin-resistant Nissle was administered to mice via oral gavage without antibiotic pre-treatment. Fecal pellets from 6 total mice were monitored post-administration to determine the amount of administered Nissle still residing within the mouse gastrointestinal tract. The bars represent the number of bacteria administered to the mice. The line represents the number of Nissle recovered from the fecal samples each day for 10 consecutive days.

FIG. 64 depicts a graph of Nissle residence in vivo. Streptomycin-resistant Nissle was administered to mice via oral gavage without antibiotic pre-treatment. Fecal pellets from six total mice were monitored post-administration to determine the amount of administered Nissle still residing within the mouse gastrointestinal tract. The bars represent the number of bacteria administered to the mice. The line represents the number of Nissle recovered from the fecal samples each day for 10 consecutive days.

TABLE 80

| Nissle residence in vivo | | | | |
|---|---|---|---|---|
| ID | Day 2 | Day 3 | Day 4 | Day 5 |
| 1 | 2.40E+05 | 6.50E+03 | 6.00E+04 | 2.00E+03 |
| 2 | 1.00E+05 | 1.00E+04 | 3.30E+04 | 3.00E+03 |
| 3 | 6.00E+04 | 1.70E+04 | 6.30E+04 | 2.00E+02 |
| 4 | 3.00E+04 | 1.50E+04 | 1.10E+05 | 3.00E+02 |
| 5 |  | 1.00E+04 | 3.00E+05 | 1.50E+04 |
| 6 |  | 1.00E+06 | 4.00E+05 | 2.30E+04 |
| Avg | 1.08E+05 | 1.76E+05 | 1.61E+05 | 7.25E+03 |

| ID | Day 6 | Day 7 | Day 8 | Day 9 | Day 10 |
|---|---|---|---|---|---|
| 1 | 9.10E+03 | 1.70E+03 | 4.30E+03 | 6.40E+03 | 2.77E+03 |
| 2 | 6.00E+03 | 7.00E+02 | 6.00E+02 | 0.00E+00 | 0.00E+00 |
| 3 | 1.00E+02 | 2.00E+02 | 0.00E+00 | 0.00E+00 | 0.00E+00 |
| 4 | 1.50E+03 | 1.00E+02 |  | 0.00E+00 | 0.00E+00 |
| 5 | 3.10E+04 | 3.60E+03 |  | 0.00E+00 | 0.00E+00 |
| 6 | 1.50E+03 | 1.40E+03 | 4.20E+03 | 1.00E+02 | 0.00E+00 |
| Avg | 8.20E+03 | 1.28E+03 | 2.28E+03 | 1.08E+03 | 4.62E+02 |

Example 35

Intestinal Residence and Survival of Bacterial Strains In Vivo

Localization and intestinal residence time of streptomycin resistant Nissle, FIG. 56, was determined. Mice were gavaged, sacrificed at various time points, and effluents were collected from various areas of the small intestine cecum and colon.

Bacterial cultures were grown overnight and pelleted. The pellets were resuspended in PBS at a final concentration of approximately $10^{10}$ CFU/mL. Mice (C57BL6/J, 10-12 weeks old) were gavaged with 100 µL of bacteria (approximately $10^9$ CFU). Drinking water for the mice was changed to contain 0.1 mg/mL anhydrotetracycline (ATC) and 5% sucrose for palatability. At each timepoint (1, 4, 8, 12, 24, and 30 hours post-gavage), animals (n=4) were euthanized, and intestine, cecum, and colon were removed. The small intestine was cut into three sections, and the large intestine and colon each into two sections. Each section was flushed with 0.5 ml cold PBS and collected in separate 1.5 ml tubes. The cecum was harvested, contents were squeezed out, and flushed with 0.5 ml cold PBS and collected in a 1.5 ml tube. Intestinal effluents were placed on ice for serial dilution plating.

In order to determine the CFU of bacteria in each effluent, the effluent was serially diluted, and plated onto LB plates containing kanamycin. The plates were incubated at 37° C. overnight, and colonies were counted. The amount of bacteria and residence time in each compartment is shown in FIG. 56.

Example 36

Efficacy of Butyrate-Expressing Bacteria in a Mouse Model of IBD

Bacteria harboring the butyrate cassettes described above are grown overnight in LB. Bacteria are then diluted 1:100 into LB containing a suitable selection marker, e.g., ampicillin, and grown to an optical density of 0.4-0.5 and then pelleted by centrifugation. Bacteria are resuspended in phosphate buffered saline and 100 microliters is administered by oral gavage to mice. IBD is induced in mice by supplementing drinking water with 3% dextran sodium sulfate for 7 days prior to bacterial gavage. Mice are treated daily for 1 week and bacteria in stool samples are detected by plating stool homogenate on agar plates supplemented with a suitable selection marker, e.g., ampicillin. After 5 days of bacterial treatment, colitis is scored in live mice using endoscopy. Endoscopic damage score is determined by assessing colon translucency, fibrin attachment, mucosal and vascular pathology, and/or stool characteristics. Mice are sacrificed and colonic tissues are isolated. Distal colonic sections are fixed and scored for inflammation and ulceration. Colonic tissue is homogenized and measurements are made for myeloperoxidase activity using an enzymatic assay kit and for cytokine levels (IL-1β, TNF-α, IL-6, IFN-γ and IL-10).

Example 37

Generating a DSS-Induced Mouse Model of IBD

The genetically engineered bacteria described in Example 1 can be tested in the dextran sodium sulfate (DSS)-induced mouse model of colitis. The administration of DSS to animals results in chemical injury to the intestinal epithelium, allowing proinflammatory intestinal contents (e.g., luminal antigens, enteric bacteria, bacterial products) to disseminate and trigger inflammation (Low et al., 2013). To prepare mice for DSS treatment, mice are labeled using ear punch, or any other suitable labeling method. Labeling individual mice allows the investigator to track disease progression in each mouse, since mice show differential susceptibilities and responsiveness to DSS induction. Mice are then weighed, and if required, the average group weight is equilibrated to eliminate any significant weight differences between groups. Stool is also collected prior to DSS administration, as a control for subsequent assays. Exemplary assays for fecal markers of inflammation (e.g., cytokine levels or myeloperoxidase activity) are described below.

For DSS administration, a 3% solution of DSS (MP Biomedicals, Santa Ana, Calif.; Cat. No. 160110) in autoclaved water is prepared. Cage water bottles are then filled with 100 mL of DSS water, and control mice are given the same amount of water without DSS supplementation. This amount is generally sufficient for 5 mice for 2-3 days. Although DSS is stable at room temperature, both types of water are changed every 2 days, or when turbidity in the bottles is observed.

Acute, chronic, and resolving models of intestinal inflammation are achieved by modifying the dosage of DSS (usually 1-5%) and the duration of DSS administration (Chassaing et al., 2014). For example, acute and resolving colitis may be achieved after a single continuous exposure to DSS over one week or less, whereas chronic colitis is typically induced by cyclical administration of DSS punctuated with recovery periods (e.g., four cycles of DSS treatment for 7 days, followed by 7-10 days of water).

FIG. 14D shows that butyrate produced in vivo in DSS mouse models under the control of an FNR promoter can be gut protective. LCN2 and calprotectin are both a measure of gut barrier disruption (measure by ELISA in this assay). FIG. 14D shows that SYN-501 (ter substitution) reduces inflammation and/or protects gut barrier as compared to wildtype Nissle.

Example 38

Monitoring Disease Progression In Vivo

Following initial administration of DSS, stool is collected from each animal daily, by placing a single mouse in an empty cage (without bedding material) for 15-30 min. However, as DSS administration progresses and inflammation becomes more robust, the time period required for collection increases. Stool samples are collected using sterile forceps, and placed in a microfuge tube. A single pellet is used to monitor occult blood according to the following scoring system: 0, normal stool consistency with negative hemoccult; 1, soft stools with positive hemoccult; 2, very soft stools with traces of blood; and 3, watery stools with visible rectal bleeding. This scale is used for comparative analysis of intestinal bleeding. All remaining stool is reserved for the measurement of inflammatory markers, and frozen at −20° C.

The body weight of each animal is also measured daily. Body weights may increase slightly during the first three days following initial DSS administration, and then begin to decrease gradually upon initiation of bleeding. For mouse models of acute colitis, DSS is typically administered for 7 days. However, this length of time may be modified at the discretion of the investigator.

Example 39

In Vivo Efficacy of Genetically Engineered Bacteria Following DSS Induction

The genetically engineered bacteria described in Example 1 can be tested in DSS-induced animal models of IBD. Bacteria are grown overnight in LB supplemented with the appropriate antibiotic. Bacteria are then diluted 1:100 in fresh LB containing selective antibiotic, grown to an optical density of 0.4-0.5, and pelleted by centrifugation. Bacteria are then resuspended in phosphate buffered saline (PBS). IBD is induced in mice by supplementing drinking water with 3% DSS for 7 days prior to bacterial gavage. On day 7 of DSS treatment, 100 µL of bacteria (or vehicle) is administered to mice by oral gavage. Bacterial treatment is repeated once daily for 1 week, and bacteria in stool samples are detected by plating stool homogenate on selective agar plates.

After 5 days of bacterial treatment, colitis is scored in live mice using the Coloview system (Karl Storz Veterinary Endoscopy, Goleta, Calif.). In mice under 1.5-2.0% isoflurane anesthesia, colons are inflated with air and approximately 3 cm of the proximal colon can be visualized (Chassaing et al., 2014). Endoscopic damage is scored by assessing colon translucency (score 0-3), fibrin attachment to the bowel wall (score 0-3), mucosal granularity (score 0-3), vascular pathology (score 0-3), stool characteristics (normal to diarrhea; score 0-3), and the presence of blood in the lumen (score 0-3), to generate a maximum score of 18. Mice are sacrificed and colonic tissues are isolated using protocols described in Examples 8 and 9. Distal colonic sections are fixed and scored for inflammation and ulceration. Remaining colonic tissue is homogenized and cytokine levels (e.g., IL-1β, TNF-α, IL-6, IFN-γ, and IL-10), as well as myeloperoxidase activity, are measured using methods described below.

Example 40

Euthanasia Procedures for Rodent Models of IBD

Four and 24 hours prior to sacrifice, 5-bromo-2'-deooxyuridine (BrdU) (Invitrogen, Waltham, Mass.; Cat. No. B23151) may be intraperitoneally administered to mice, as recommended by the supplier. BrdU is used to monitor intestinal epithelial cell proliferation and/or migration via immunohistochemistry with standard anti-BrdU antibodies (Abcam, Cambridge, Mass.).

On the day of sacrifice, mice are deprived of food for 4 hours, and then gavaged with FITC-dextran tracer (4 kDa, 0.6 mg/g body weight). Fecal pellets are collected, and mice are euthanized 3 hours following FITC-dextran administration. Animals are then cardiac bled to collect hemolysis-free serum. Intestinal permeability correlates with fluorescence intensity of appropriately diluted serum (excitation, 488 nm; emission, 520 nm), and is measured using spectrophotometry. Serial dilutions of a known amount of FITC-dextran in mouse serum are used to prepare a standard curve.

Alternatively, intestinal inflammation is quantified according to levels of serum keratinocyte-derived chemokine (KC), lipocalin 2, calprotectin, and/or CRP-1. These proteins are reliable biomarkers of inflammatory disease activity, and are measured using DuoSet ELISA kits (R&D Systems, Minneapolis, Minn.) according to manufacturer's instructions. For these assays, control serum samples are diluted 1:2 or 1:4 for KC, and 1:200 for lipocalin 2. Samples from DSS-treated mice require a significantly higher dilution.

Example 41

Isolation and Preservation of Colonic Tissues

To isolate intestinal tissues from mice, each mouse is opened by ventral midline incision. The spleen is then removed and weighed. Increased spleen weights generally correlate with the degree of inflammation and/or anemia in the animal. Spleen lysates (100 mg/mL in PBS) plated on non-selective agar plates are also indicative of disseminated intestinal bacteria. The extent of bacterial dissemination should be consistent with any FITC-dextran permeability data.

Mesenteric lymph nodes are then isolated. These may be used to characterize immune cell populations and/or assay the translocation of gut bacteria. Lymph node enlargement is also a reliable indicator of DSS-induced pathology. Finally, the colon is removed by lifting the organ with forceps and carefully pulling until the cecum is visible. Colon dissection from severely inflamed DSS-treated mice is particularly difficult, since the inflammatory process causes colonic tissue to thin, shorten, and attach to extraintestinal tissues.

The colon and cecum are separated from the small intestine at the ileocecal junction, and from the anus at the distal end of the rectum. At this point, the mouse intestine (from cecum to rectum) may be imaged for gross analysis, and colonic length may be measured by straightening (but not stretching) the colon. The colon is then separated from the cecum at the ileocecal junction, and briefly flushed with cold PBS using a 5- or 10-mL syringe (with a feeding needle). Flushing removes any feces and/or blood. However, if histological staining for mucin layers or bacterial adhesion/translocation is ultimately anticipated, flushing the colon with PBS should be avoided. Instead, the colon is immersed in Carnoy's solution (60% ethanol, 30% chloroform, 10% glacial acetic acid; Johansson et al., 2008) to preserve mucosal architecture. The cecum can be discarded, as DSS-induced inflammation is generally not observed in this region.

After flushing, colon weights are measured. Inflamed colons exhibit reduced weights relative to normal colons due to tissue wasting, and reductions in colon weight correlate with the severity of acute inflammation. In contrast, in chronic models of colitis, inflammation is often associated with increased colon weight. Increased weight may be attributed to focal collections of macrophages, epithelioid cells, and multinucleated giant cells, and/or the accumulation of other cells, such as lymphocytes, fibroblasts, and plasma cells (Williams and Williams, 1983).

To obtain colon samples for later assays, colons are cut into the appropriate number of pieces. It is important to compare the same region of the colon from different groups of mice when performing any assay. For example, the proximal colon is frozen at −80° C. and saved for MPO analysis, the middle colon is stored in RNA later and saved for RNA isolation, and the rectal region is fixed in 10% formalin for histology. Alternatively, washed colons may be cultured ex vivo. Exemplary protocols for each of these assays are described below.

Example 42

Myeloperoxidase Activity Assay

Granulocyte infiltration in the rodent intestine correlates with inflammation, and is measured by the activity levels of myeloperoxidase, an enzyme abundantly expressed in neutrophil granulocytes. Myeloperoxidase (MPO) activity may be quantified using either o-dianisidine dihydrochloride (Sigma, St. Louis, Mo.; Cat. No. D3252) or 3,3',5,5'-tetramethylbenzidine (Sigma; Cat. No. T2885) as a substrate.

Briefly, clean, flushed samples of colonic tissue (50-100 mg) are removed from storage at −80° C. and immediately placed on ice. Samples are then homogenized in 0.5% hexadecyltrimethylammonium bromide (Sigma; Cat. No. H6269) in 50 mM phosphate buffer, pH 6.0. Homogenates are then disrupted for 30 sec by sonication, snap-frozen in dry ice, and thawed for a total of three freeze-thaw cycles before a final sonication for 30 sec.

For assays with o-dianisidine dihydrochloride, samples are centrifuged for 6 min at high speed (13,400 g) at 4° C. MPO in the supernatant is then assayed in a 96-well plate by adding 1 mg/mL of o-dianisidine dihydrochloride and 0.5× $10^{-4}$% $H_2O_2$, and measuring optical density at 450 nm. A brownish yellow color develops slowly over a period of 10-20 min; however, if color development is too rapid, the assay is repeated after further diluting the samples. Human neutrophil MPO (Sigma; Cat. No. M6908) is used as a standard, with a range of 0.5-0.015 units/mL. One enzyme unit is defined as the amount of enzyme needed to degrade 1.0 μmol of peroxide per minute at 25° C. This assay is used to analyze MPO activity in rodent colonic samples, particularly in DSS-induced tissues.

For assays with 3,3',5,5'-tetramethylbenzidine (TMB), samples are incubated at 60° C. for 2 hours and then spun down at 4,000 g for 12 min. Enzymatic activity in the supernatant is quantified photometrically at 630 nm. The assay mixture consists of 20 mL supernatant, 10 mL TMB (final concentration, 1.6 mM) dissolved in dimethylsulfoxide, and 70 mL $H_2O_2$ (final concentration, 3.0 mM) diluted in 80 mM phosphate buffer, pH 5.4. One enzyme unit is defined as the amount of enzyme that produces an increase of one absorbance unit per minute. This assay is used to analyze MPO activity in rodent colonic samples, particularly in tissues induced by trinitrobenzene (TNBS) as described herein.

Example 43

RNA Isolation and Gene Expression Analysis

To gain further mechanistic insights into how the genetically engineered bacteria may reduce gut inflammation in vivo, gene expression is evaluated by semi-quantitative and/or real-time reverse transcription PCR.

For semi-quantitative analysis, total RNA is extracted from intestinal mucosal samples using the RNeasy isolation kit (Qiagen, Germantown, Md.; Cat. No. 74106). RNA concentration and purity are determined based on absorbency measurements at 260 and 280 nm. Subsequently, 1 μg of total RNA is reverse-transcribed, and cDNA is amplified for the following genes: tumor necrosis factor alpha (TNF-α), interferon-gamma (IFN-γ), interleukin-2 (IL-2), or any other gene associated with inflammation. Glyceraldehyde-3-phosphate dehydrogenase (GAPDH) is used as the internal standard. Polymerase chain reaction (PCR) reactions are performed with a 2-min melting step at 95° C., then 25 cycles of 30 sec at 94° C., 30 sec at 63° C., and 1 min at 75° C., followed by a final extension step of 5 min at 65° C. Reverse transcription (RT)-PCR products are separated by size on a 4% agarose gel and stained with ethidium bromide. Relative band intensities are analyzed using standard image analysis software.

For real-time, quantitative analysis, intestinal samples (50 mg) are stored in RNAlater solution (Sigma; Cat. No. R0901) until RNA extraction. Samples should be kept frozen at −20° C. for long-term storage. On the day of RNA extraction, samples are thawed, or removed from RNAlater, and total RNA is extracted using Trizol (Fisher Scientific, Waltham, Mass.; Cat. No. 15596026). Any suitable RNA extraction method may be used. When working with DSS-induced samples, it is necessary to remove all polysaccharides (including DSS) using the lithium chloride method (Chassaing et al., 2012). Traces of DSS in colonic tissues are known to interfere with PCR amplification in subsequent steps.

Primers are designed for various genes and cytokines associated with the immune response using Primer Express® software (Applied Biosystems, Foster City, Calif.). Following isolation of total RNA, reverse transcription is performed using random primers, dNTPs, and Superscript® II enzyme (Invitrogen; Ser. No. 18/064,014). cDNA is then used for real-time PCR with SYBR Green PCR Master Mix (Applied Biosystems; 4309155) and the ABI PRISM 7000 Sequence Detection System (Applied Biosystems), although any suitable detection method may be used. PCR products are validated by melt analysis.

Example 44

Histology

Standard histological stains are used to evaluate intestinal inflammation at the microscopic level. Hematoxylin-eosin (H&E) stain allows visualization of the quality and dimension of cell infiltrates, epithelial changes, and mucosal architecture (Erben et al., 2014). Periodic Acid-Schiff (PAS) stain is used to stain for carbohydrate macromolecules (e.g., glycogen, glycoproteins, mucins). Goblet cells, for example, are PAS-positive due to the presence of mucin.

Swiss rolls are recommended for most histological stains, so that the entire length of the rodent intestine may be examined. This is a simple technique in which the intestine is divided into portions, opened longitudinally, and then rolled with the mucosa outwards (Moolenbeek and Ruitenberg, 1981). Briefly, individual pieces of colon are cut longitudinally, wrapped around a toothpick wetted with PBS, and placed in a cassette. Following fixation in 10% formalin for 24 hours, cassettes are stored in 70% ethanol until the day of staining. Formalin-fixed colonic tissue may be stained for BrdU using anti-BrdU antibodies (Abcam). Alternatively, Ki67 may be used to visualize epithelial cell proliferation. For stains using antibodies to more specific targets (e.g., immunohistochemistry, immunofluorescence), frozen sections are fixed in a cryoprotective embedding medium, such as Tissue-Tek® OCT (VWR, Radnor, Pa.; Cat. No. 25608-930).

For H&E staining, stained colonic tissues are analyzed by assigning each section four scores of 0-3 based on the extent of epithelial damage, as well as inflammatory infiltration into the mucosa, submucosa, and muscularis/serosa. Each of these scores is multiplied by: 1, if the change is focal; 2, if the change is patchy; and 3, if the change is diffuse. The four individual scores are then summed for each colon, resulting in a total scoring range of 0-36 per animal. Average scores for the control and affected groups are tabulated. Alternative scoring systems are detailed herein.

Example 45

Ex Vivo Culturing of Rodent Colons

Culturing colons ex vivo may provide information regarding the severity of intestinal inflammation. Longitudinally-cut colons (approximately 1.0 cm) are serially washed three times in Hanks' Balanced Salt Solution with 1.0% penicillin/streptomycin (Fisher; Cat. No. BP295950). Washed colons are then placed in the wells of a 24-well plate, each containing 1.0 mL of serum-free RPMI1640 medium (Fisher; Cat. No. 11875093) with 1.0% penicillin/streptomycin, and incubated at 37° C. with 5.0% $CO_2$ for 24 hours. Following incubation, supernatants are collected and centrifuged for 10 min at 4° C. Supernatants are stored at −80° C. prior to analysis for proinflammatory cytokines.

Example 46

In Vivo Efficacy of Genetically Engineered Bacteria Following TNBS Induction

Apart from DSS, the genetically engineered bacteria described in 1 can also be tested in other chemically induced animal models of IBD. Non-limiting examples include those induced by oxazolone (Boirivant et al., 1998), acetic acid (MacPherson and Pfeiffer, 1978), indomethacin (Sabiu et al., 2016), sulfhydryl inhibitors (Satoh et al., 1997), and trinitrobenzene sulfonic acid (TNBS) (Gurtner et al., 2003; Segui et al., 2004). To determine the efficacy of the genetically engineered bacteria in a TNBS-induced mouse model of colitis, bacteria are grown overnight in LB supplemented with the appropriate antibiotic. Bacteria are then diluted 1:100 in fresh LB containing selective antibiotic, grown to an optical density of 0.4-0.5, and pelleted by centrifugation. Bacteria are resuspended in PBS. IBD is induced in mice by intracolonic administration of 30 mg TNBS in 0.25 mL 50% (vol/vol) ethanol (Segui et al., 2004). Control mice are administered 0.25 mL saline. Four hours post-induction, 100 µL of bacteria (or vehicle) is administered to mice by oral gavage. Bacterial treatment is repeated once daily for 1 week. Animals are weighed daily.

After 7 days of bacterial treatment, mice are sacrificed via intraperitoneal administration of thiobutabarbital (100 mg/kg). Colonic tissues are isolated by blunt dissection, rinsed with saline, and weighed. Blood samples are collected by open cardiac puncture under aseptic conditions using a 1-mL syringe, placed in Eppendorf vials, and spun at 1,500 g for 10 min at 4° C. The supernatant serum is then pipetted into autoclaved Eppendorf vials and frozen at −80° C. for later assay of IL-6 levels using a quantitative, colorimetric commercial kit (R&D Systems).

Macroscopic damage is examined under a dissecting microscope by a blinded observer. An established scoring system is used to account for the presence/severity of intestinal adhesions (score 0-2), strictures (score 0-3), ulcers (score 0-3), and wall thickness (score 0-2) (Mourelle et al., 1996). Two colon samples (50 mg) are then excised, snap-frozen in liquid nitrogen, and stored at −80° C. for subsequent myeloperoxidase activity assay. If desired, additional samples are preserved in 10% formalin for histologic grading. Formalin-fixed colonic samples are then embedded in paraffin, and 5 µm sections are stained with H&E. Microscopic inflammation of the colon is assessed on a scale of 0 to 11, according to previously defined criteria (Appleyard and Wallace, 1995).

Example 47

Generating a Cell Transfer Mouse Model of IBD

The genetically engineered bacteria described in Example 1 can be tested in cell transfer animal models of IBD. One exemplary cell transfer model is the CD45RBHi T cell transfer model of colitis (Bramhall et al., 2015; Ostanin et al., 2009; Sugimoto et al., 2008). This model is generated by sorting CD4+ T cells according to their levels of CD45RB expression, and adoptively transferring CD4+ T cells with high CD45RB expression (referred to as CD45RBHi T cells) from normal donor mice into immunodeficient mice (e.g., SCID or RAG−/− mice). Specific protocols are described below.

Enrichment for CD4 T Cells

Following euthanization of C57BL/6 wild-type mice of either sex (Jackson Laboratories, Bar Harbor, Me.), mouse spleens are removed and placed on ice in a 100 mm Petri dish containing 10-15 mL of FACS buffer (1×PBS without Ca2+/Mg2+, supplemented with 4% fetal calf serum). Spleens are teased apart using two glass slides coated in FACS buffer, until no large pieces of tissue remain. The cell suspension is then withdrawn from the dish using a 10-mL syringe (no needle), and expelled out of the syringe (using a 26-gauge needle) into a 50-mL conical tube placed on ice. The Petri dish is washed with an additional 10 mL of FACS buffer, using the same needle technique, until the 50-mL conical tube is full. Cells are pelleted by centrifugation at 400 g for 10 min at 4° C. After the cell pellet is gently disrupted with a stream of FACS buffer, cells are counted. Cells used for counting are kept on ice and saved for single-color staining described in the next section. All other cells (i.e., those remaining in the 50-mL conical tube) are transferred to new 50-mL conical tubes. Each tube should contain a maximum of $25 \times 10^7$ cells.

To enrich for CD4+ T cells, the Dynal® Mouse CD4 Negative Isolation kit (Invitrogen; Cat. No. 114-15D) is used as per manufacturer's instructions. Any comparable CD4+ T cell enrichment method may be used. Following negative selection, CD4+ cells remain in the supernatant. Supernatant is carefully pipetted into a new 50-mL conical tube on ice, and cells are pelleted by centrifugation at 400 g for 10 min at 4° C. Cell pellets from all 50-mL tubes are then resuspended, pooled into a single 15-mL tube, and pelleted once more by centrifugation. Finally, cells are resuspended in 1 mL of fresh FACS buffer, and stained with anti-CD4-APC and anti-CD45RB-FITC antibodies.

Fluorescent Labeling of CD4+ T Cells

To label CD4+ T cells, an antibody cocktail containing appropriate dilutions of pre-titrated anti-CD4-APC and anti-CD45RB-FITC antibodies in FACS buffer (approximately 1 mL cocktail/$5 \times 10^7$ cells) is added to a 1.5-mL Eppendorf tube, and the volume is adjusted to 1 mL with FACS buffer. Antibody cocktail is then combined with cells in a 15-mL tube. The tube is capped, gently inverted to ensure proper mixing, and incubated on a rocking platform for 15 min at 4° C.

During the incubation period, a 96-well round-bottom staining plate is prepared by transferring equal aliquots of counted cells (saved from the previous section) into each well of the plate that corresponds to single-color control staining. These wells are then filled to 2004 with FACs buffer, and the cells are pelleted at 300 g for 3 min at 4° C. using a pre-cooled plate centrifuge. Following centrifugation, the supernatant is discarded using a 21-gauge needle attached to a vacuum line, and 100 μL of anti-CD16/32 antibody (Fc receptor-blocking) solution is added to each well to prevent non-specific binding. The plate is incubated on a rocking platform at 4° C. for 15 min. Cells are then washed with 200 μL FACS buffer and pelleted by centrifugation. Supernatant is aspirated, discarded, and 100 μL of the appropriate antibody (i.e., pre-titrated anti-CD4-APC or anti-CD45RB-FITC) is added to wells corresponding to each single-color control. Cells in unstained control wells are resuspended in 100 μL FACS buffer. The plate is incubated on a rocking platform at 4° C. for 15 min. After two washes, cells are resuspended in 200 μL of FACS buffer, transferred into twelve 75-mm flow tubes containing 150-200 μL of FACS buffer, and the tubes are placed on ice.

Following incubation, cells in the 15-mL tube containing antibody cocktail are pelleted by centrifugation at 400 g for 10 min at 4° C., and resuspended in FACS buffer to obtain a concentration of $25-50 \times 10^6$ cells/mL.

Purification of CD4+CD45RBHi T Cells

Cell sorting of CD45RBHi and CD45RBLow populations is performed using flow cytometry. Briefly, a sample of unstained cells is used to establish baseline autofluorescence, and for forward scatter vs. side scatter gating of lymphoid cells. Single-color controls are used to set the appropriate levels of compensation to apply to each fluorochrome. However, with FITC and APC fluorochromes, compensation is generally not required. A single-parameter histogram (gated on singlet lymphoid cells) is then used to gate CD4+(APC+) singlet cells, and a second singlet-parameter (gated on CD4+ singlet cells) is collected to establish sort gates. The CD45RBHi population is defined as the 40% of cells which exhibit the brightest CD45RB staining, whereas the CD45RBLow population is defined as the 15% of cells with the dimmest CD45RB expression. Each of these populations is sorted individually, and the CD45RBHi cells are used for adoptive transfer.

Adoptive Transfer

Purified populations of CD4+CD45RBHi cells are adoptively transferred into 6- to 8-week-old RAG−/− male mice. The collection tubes containing sorted cells are filled with FACS buffer, and the cells are pelleted by centrifugation. The supernatant is then discarded, and cells are resuspended in 500 μL PBS. Resuspended cells are transferred into an injection tube, with a maximum of 5×106 cells per tube, and diluted with cold PBS to a final concentration of 1×106 cells/mL. Injection tubes are kept on ice.

Prior to injection, recipient mice are weighed and injection tubes are gently inverted several times to mix the cells. Mixed cells (0.5 mL, ~0.5×106 cells) are carefully drawn into a 1-mL syringe with a 26G3/8 needle attached. Cells are then intraperitoneally injected into recipient mice.

Example 48

Efficacy of Genetically Engineered Bacteria in a CD45RBHi T Cell Transfer Model

To determine whether the genetically engineered bacteria of the disclosure are efficacious in CD45RBHi T cell transfer mice, disease progression following adoptive transfer is monitored by weighing each mouse on a weekly basis. Typically, modest weight increases are observed over the first 3 weeks post-transfer, followed by slow but progressive weight loss over the next 4-5 weeks. Weight loss is generally accompanied by the appearance of loose stools and diarrhea.

At weeks 4 or 5 post-transfer, as recipient mice begin to develop signs of disease, the genetically engineered bacteria described in Example 1 are grown overnight in LB supplemented with the appropriate antibiotic. Bacteria are then diluted 1:100 in fresh LB containing selective antibiotic, grown to an optical density of 0.4-0.5, and pelleted by centrifugation. Bacteria are resuspended in PBS and 100 nt of bacteria (or vehicle) is administered by oral gavage to CD45RBHi T cell transfer mice. Bacterial treatment is repeated once daily for 1-2 weeks before mice are euthanized. Murine colonic tissues are isolated and analyzed using the procedures described above.

Example 49

Efficacy of Genetically Engineered Bacteria in a Genetic Mouse Model of IBD

The genetically engineered bacteria described in Example 1 can be tested in genetic (including congenic and genetically modified) animal models of IBD. For example, IL-10 is an anti-inflammatory cytokine and the gene encoding IL-10 is a susceptibility gene for both Crohn's disease and ulcerative colitis (Khor et al., 2011). Functional impairment of IL-10, or its receptor, has been used to create several mouse models for the study of inflammation (Bramhall et al., 2015). IL-10 knockout (IL-10−/−) mice housed under normal conditions develop chronic inflammation in the gut (Iyer and Cheng, 2012).

To determine whether the genetically engineered bacteria of the disclosure are efficacious in IL-10−/− mice, bacteria are grown overnight in LB supplemented with the appropriate antibiotic. Bacteria are then diluted 1:100 in fresh LB containing selective antibiotic, grown to an optical density of 0.4-0.5, and pelleted by centrifugation. Bacteria are resuspended in PBS and 100 μL of bacteria (or vehicle) is administered by oral gavage to IL-10−/− mice. Bacterial treatment is repeated once daily for 1-2 weeks before mice are euthanized. Murine colonic tissues are isolated and analyzed using the procedures described above.

Protocols for testing the genetically engineered bacteria are similar for other genetic animal models of IBD. Such models include, but are not limited to, transgenic mouse models, e.g., SAMP1/YitFc (Pizarro et al., 2011), dominant negative N-cadherin mutant (NCAD delta; Hermiston and Gordon, 1995), TNFΔARE (Wagner et al., 2013), IL-7 (Watanabe et al., 1998), C3H/HeJBir (Elson et al., 2000), and dominant negative TGF-β receptor II mutant (Zhang et al., 2010); and knockout mouse models, e.g., TCRα−/− (Mombaerts et al., 1993; Sugimoto et al., 2008), WASP−/− (Nguyen et al., 2007), Mdr1a−/− (Wilk et al., 2005), IL-2 Rα−/− (Hsu et al., 2009), Gαi2−/− (Ohman et al., 2002), and TRUC (Tbet−/−Rag2−/−; Garrett et al., 2007).

Example 50

Efficacy of Genetically Engineered Bacteria in a Transgenic Rat Model of IBD

The genetically engineered bacteria described in Example 1 can be tested in non-murine animal models of IBD. The introduction of human leukocyte antigen B27 (HLA-B27) and the human β2-microglobulin gene into Fisher (F344) rats induces spontaneous, chronic inflammation in the GI tract (Alavi et al., 2000; Hammer et al., 1990). To investigate whether the genetically engineered bacteria of the invention are capable of ameliorating gut inflammation in this model, bacteria are grown overnight in LB supplemented with the appropriate antibiotic. Bacteria are then diluted 1:100 in fresh LB containing selective antibiotic, grown to an optical density of 0.4-0.5, and pelleted by centrifugation. Bacteria are resuspended in PBS and 100 μL of bacteria (or vehicle) is administered by oral gavage to transgenic F344-HLA-B27 rats. Bacterial treatment is repeated once daily for 2 weeks.

To determine whether bacterial treatment reduces the gross and histological intestinal lesions normally present in F344-HLA-B27 rats at 25 weeks of age, all animals are sacrificed at day 14 following the initial treatment. The GI tract is then resected from the ligament of Treitz to the rectum, opened along the antimesenteric border, and imaged using a flatbed scanner. Total mucosal damage, reported as a percent of the total surface area damaged, is quantified using standard image analysis software.

For microscopic analysis, samples (0.5-1.0 cm) are excised from both normal and diseased areas of the small and large intestine. Samples are fixed in formalin and embedded in paraffin before sections (5 μm) are processed for H&E staining. The stained sections are analyzed and scored as follows: 0, no inflammation; 1, mild inflammation extending into the submucosa; 2, moderate inflammation extending into the muscularis propria; and 3, severe inflammation. The scores are combined and reported as mean±standard error.

Example 51

Tryptophan Production in an Engineered Strain of E. coli Nissle

A number of tryptophan metabolites, either host-derived (such as tryptamine or kynurerine) or intestinal bacteria-derived (such as indoleacetate or indole), have been shown to downregulate inflammation in the context of IBD, via the activation of the AhR receptor. Other tryptophan metabolites, such as the bacteria-derived indolepropionate, have been shown to help restore intestinal barrier integrity, in experimental models of colitis. In this example, the E. coli strain Nissle was engineered to produce tryptophan, the precursor to all those beneficial metabolites.

First, in order to remove the negative regulation of tryptophan biosynthetic genes mediated by the transcription factor TrpR, the trpR gene was deleted form the E. coli Nissle genome. The tryptophan operon trpEDCBA was amplified by PCR from the E. coli Nissle genomic DNA and cloned in the low-copy plasmid pSC101 under the control of the tet promoter, downstream of the tetR repressor gene. This tet-trpEDCBA plasmid was then transformed into the ΔtrpR mutant to obtain the ΔtrpR, tet-trpEDCBA strain. Subsequently, a feedback resistant version of the aroG gene (aroG$^{fbr}$) from E. coli Nissle, coding for the enzyme catalyzing the first committing step towards aromatic amino acid production, was synthetized and cloned into the medium copy plasmid p15A, under the control of the tet promoter, downstream of the tetR repressor. This plasmid was transformed into the ΔltrpR, tet-trpEDCBA strain to obtain the ΔltrpR, tet-trpEDCBA, tet-aroG$^{fbr}$ strain. Finally, a feedback resistant version of the tet-trpEBCDA construct (tet-trpE$^{fbr}$BCDA) was generated from the tet-trpEBCDA. Both the tet-aroG$^{fbr}$ and the tet-trpE$^{fbr}$BCDA constructs were transformed into the ΔtrpR mutant to obtain the ΔtrpR, tet-trpE$^{fbr}$DCBA, tet-aroG$^{fbr}$ strain.

Figure 44A:
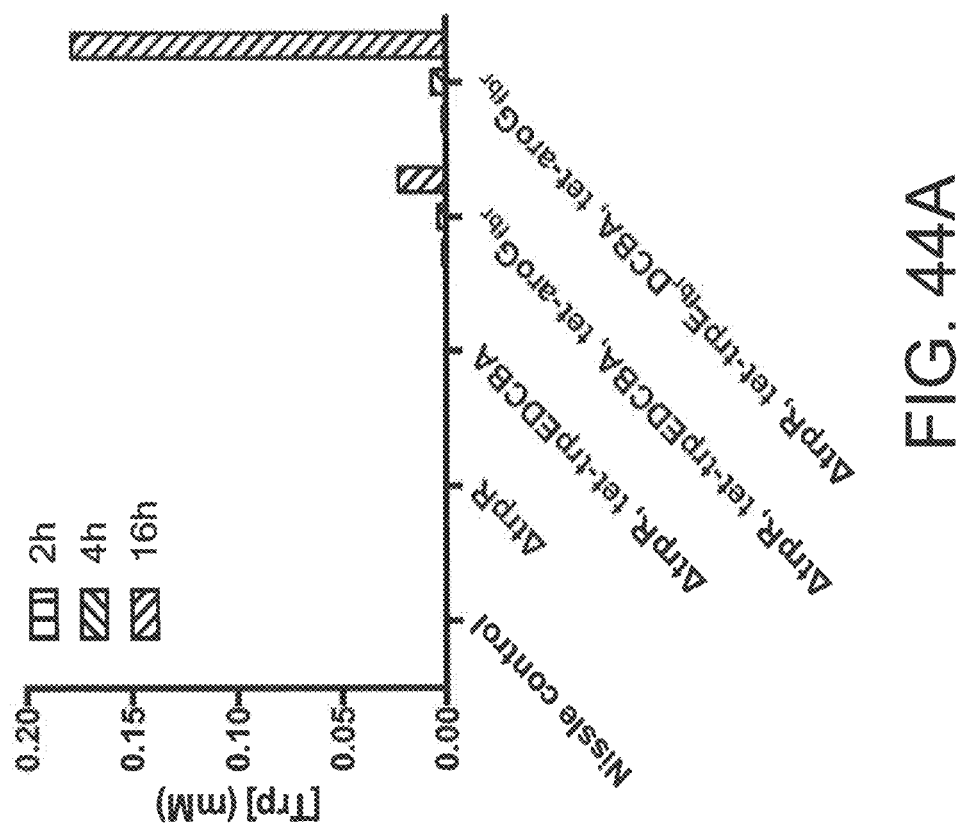
FIG. 44A and FIG. 44B and FIG. 44C depict bar graphs showing tryptophan production by various engineered bacterial strains.

All generated strains were grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 0.5% glucose and placed at 37 C at 250 rpm. 200 uL were collected at 2 h, 4 h and 16 h and tryptophan was quantified by LC-MS/MS in the bacterial supernatant. FIG. 44A shows that tryptophan is being produced and secreted by the ΔtrpR, tet-trpEDCBA, tet-aroG$^{fbr}$ strain. The production of tryptophan is significantly enhanced by expressing the feedback resistant version of trpE.

Figure 44B:
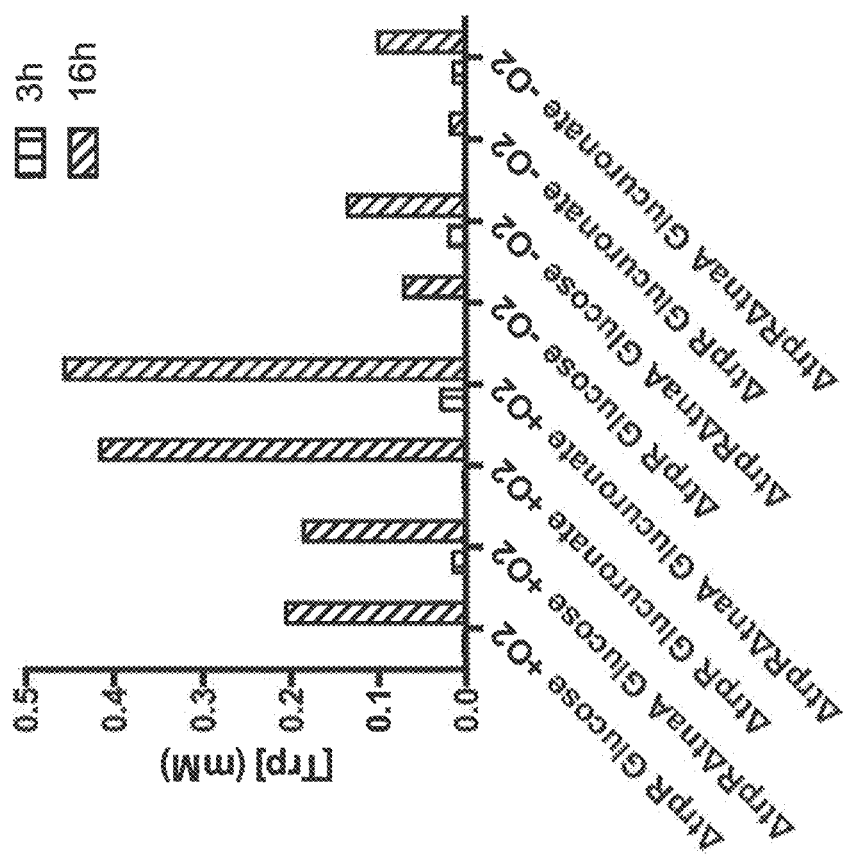

Example 52 Improved tryptophan by using a non-PTS carbon source and by deleting the tnaA gene encoding for the tryptophanase enzyme converting tryptophan into indole One of the precursor molecule to tryptophan in *E. coli* is phosphoenolpyruvate (PEP). Only 3% of available PEP is normally used to produce aromatic acids (that include tryptophan, phenylalanine and tyrosine). When *E. coli* is grown using glucose as a sole carbon source, 50% of PEP is used to import glucose into the cell using the phosphotransferase system (PTS). In order to increase tryptophan production, a non-PTS oxidized sugar, glucuronate, was used to test tryptophan secretion by the engineered *E. coli* Nissle strain AtrpR, tet-trpE$^{fbr}$DCBA, tet-aroC$^{fbr}$. In addition, the tnaA gene, encoding the tryptophanase enzyme, was deleted in the ΔtrpR, tet-trpE$^{fbr}$DCBA, tet-aroG$^{fbr}$ strain in order to block the conversion of tryptophan into indole to obtain the ΔtrpRΔtnaA, tet-trpE$^{fbr}$DCBA, tet-aroG$^{fbr}$ strain.

the ΔtrpR, tet-trpE$^{fbr}$DCBA, tet-aroG$^{fbr}$ and ΔtrpRΔtnaA, tet-trpE$^{fbr}$DCBA, tet-aroG$^{fbr}$ strains were grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 1% glucose or 1% glucuronate and placed at 37 C at 250 rpm or at 37 C in an anaerobic chamber. 200 uL were collected at 3 h and 16 h and tryptophan was quantified by LC-MS/MS in the bacterial supernatant. FIG. 44B shows that tryptophan production is doubled in aerobic condition when the non-PTS oxidized sugar glucoronate was used. In addition, the deletion of tnaA had a positive effect on tryptophan production at the 3 h time point in both aerobic and anaerobic conditions and at the 16 h time point, only in anaerobic condition.

Example 52

Figure 44C:
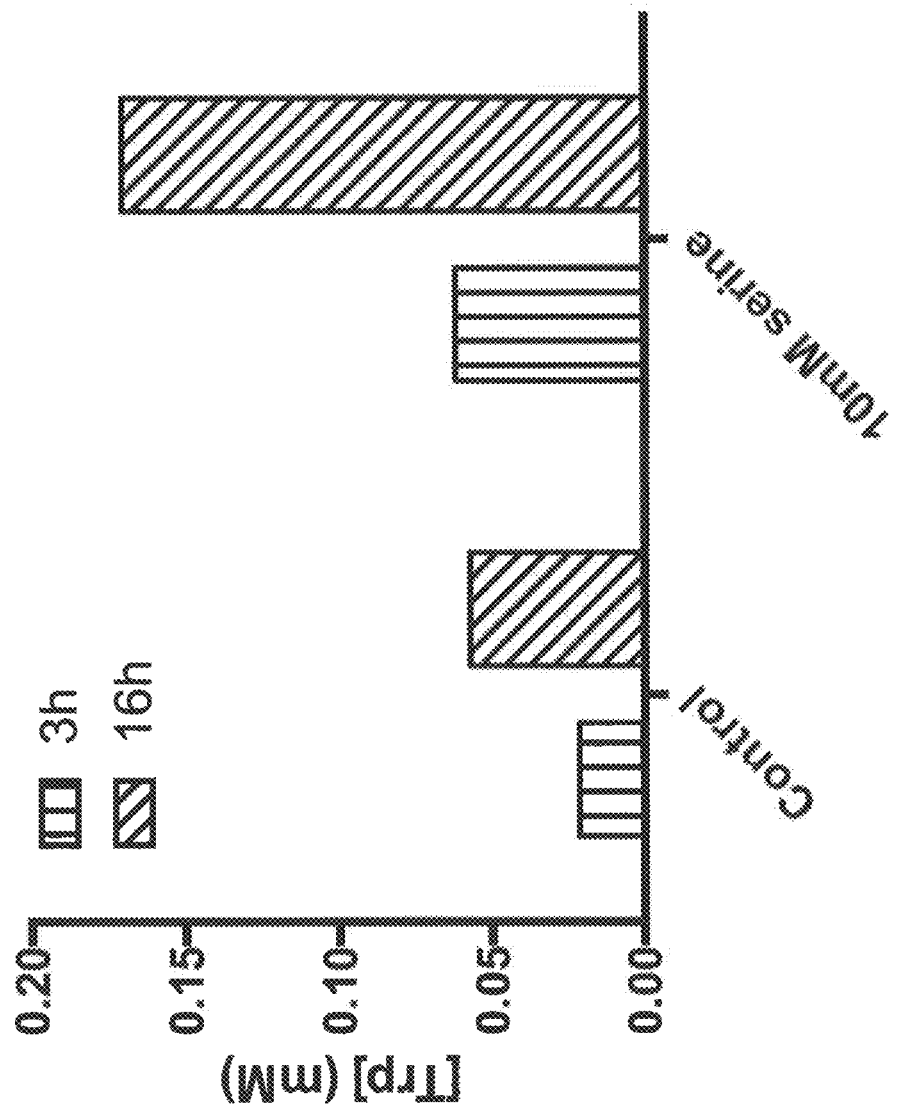

Improved Tryptophan Production by Increasing the Rate of Serine Biosynthesis in *E. coli* Nissle The last step in the tryptophan biosynthesis in *E. coli* consumes one molecule of serine. In this example, we demonstrate that serine availability is a limiting factor for tryptophan production and describe the construction of the tryptophan producing *E. coli* Nissle strains ΔtrpRΔtnaA, tet-trpE$^{fbr}$DCBA, tet-aroG$^{fbr}$serA and ΔtrpRΔtnaA, tet-trpE$^{fbr}$DCBA, tet-aroG$^{fbr}$serA$^{fbr}$ strains.

the ΔtrpRΔtnaA, tet-trpE$^{fbr}$DCBA, tet-aroG$^{fbr}$ strain was grown in LB overnight with the appropriate antibiotics and subcultured 1/100 in 3 mL LB with antibiotics in culture tubes. After two hours of growth at 37 C at 250 rpm, 100 ng/mL anhydrotetracycline (ATC) was added to the culture to induce expression of the constructs. Two hours after induction, the bacterial cells were pelleted by centrifugation at 4,000 rpm for 5 min and resuspended in 3 mL M9 minimal media. Cells were spun down again at 4,000 rpm for 5 min, resuspended in 3 mL M9 minimal media with 1% glucuronate or 1% glucuronate and 10 mM serine and placed at 37 C an anaerobic chamber. 200 uL were collected at 3 h and 16 h and tryptophan was quantified by LC-MS/MS in the bacterial supernatant. FIG. 44C shows that tryptophan production is improved three fold by serine addition.

In order to increase the rate of serine biosynthesis in the ΔtrpRΔtnaA, tet-trpE$^{fbr}$DCBA, tet-aroG$^{fbr}$ strain, the serA gene from *E. coli* Nissle encoding the enzyme catalyzing the first step in the serine biosynthetic pathway was amplified by PCR and cloned into the tet-aroG$^{fbr}$ plasmid by Gibson assembly. The newly generated tet-aroG$^{fbr}$-serA construct was then transformed into a ΔtrpRΔtnaA, tet-trpE$^{fbr}$DCBA strain to generate the ΔtrpRΔtnaA, tet-trpE$^{fbr}$DCBA, tet-aroG$^{fbr}$-serA strain. The tet-aroG$^{fbr}$-serA construct was further modified to encode a feedback resistant version of serA (serA$^{fbr}$). The newly generated tet-aroG$^{fbr}$-serA$^{fbr}$ construct was used to produce the ΔtrpRΔtnaA, tet-trpE$^{fbr}$DCBA, tet-aroG$^{fbr}$-serA$^{fbr}$ strain, optimized to improve the rate of serine biosynthesis and maximize tryptophan production.

Example 53

Synthesis of Constructs for Tryptophan Biosynthesis and Indole Metabolite Synthesis Various constructs are synthesized, and cloned into vector pBR322 for transformation of *E. coli*. In some embodiments, the constructs encoding the effector molecules are integrated into the genome.

| Description | Sequence |
| --- | --- |
| Fbr-aroG (RBS and leader region underlined) SEQ ID NO: 252 | Ctctagaaataatttgtttaactttaagaaggagatatacat atgaattatcagaacgacgatttacgcatcaaagaaatcaaagagttacttcctcctgtcgcatt gctggaaaaattccccgctactgaaaatgccgcgaatacggtcgcccatgcccgaaaagcg atccataagatcctgaaaggtaatgatgatcgcctgttggtggtgattggcccatgctcaattc atgatcctgtcgcggctaaagagtatgccactcgcttgctgacgctgcgtgaagagctgcaa gatgagctggaaatcgtgatgcgcgtctattttgaaaagccgcgtactacggtgggctggaa agggctgattaacgatccgcatatggataacagcttccagatcaacgacggtctgcgtattgc ccgcaaattgctgctcgatattaacgacagcggtctgccagcggcgggtgaattcctggata tgatcaccctacaatatctcgctgacctgatgagctggggcgcaattggcgcacgtaccacc gaatcgcaggtgcaccgcgaactggcgtctggtcttcttgtccggtaggtttcaaaaatggc actgatggtacgattaaagtggctatcgatgccattaatgccgccggtgcgccgcactgcttc ctgtccgtaacgaaatgggggcattcggcgattgtgaataccagcggtaacggcgattgcc |

| Description | Sequence |
|---|---|
|  | atatcattctgcgcggcggtaaagagcctaactacagcgcgaagcacgttgctgaagtgaa<br>agaagggctgaacaaagcaggcctgccagcgcaggtgatgatcgatttcagccatgctaac<br>tcgtcaaaacaattcaaaaagcagatggatgtttgtactgacgtttgccagcagattgccggt<br>ggcgaaaaggccattattggcgtgatggtggaaagccatctggtggaaggcaatcagagc<br>ctcgagagcggggaaccgctggcctacggtaagagcatcaccgatgcctgcattggctgg<br>gatgataccgatgctctgttacgtcaactggcgagtgcagtaaaagcgcgtcgcgggtaa |
| Fbr-aroG-serA (RBS and leader region underlined; SerA starts after second RBS)<br>SEQ ID NO: 253 | <u>Ctctagaaataattttgtttaactttaagaaggagatatacat</u>atgaattatcagaacgacgattt<br>acgcatcaaagaaatcaaagagttacttcctcctgtcgcattgctggaaaaattccccgctact<br>gaaaatgccgcgaatacggtcgcccatgcccgaaaagcgatccataagatcctgaaaggta<br>atgatgatcgcctgttggtggtgattggcccatgctcaattcatgatcctgtcgcggctaaaga<br>gtatgccactcgcttgctgacgctgcgtgaagagctgcaagatgagctggaaatcgtgatgc<br>gcgtctattttgaaaagccgcgtactacggtgggctggaaagggctgattaacgatccgcat<br>atggataacagcttccagatcaacgacggtctgcgtattgcccgcaaattgctgctcgatatta<br>cgacagcggtctgccagcggcgggtgaattcctggatatgatcaccctacaatatctcgct<br>gacctgatgagctggggcgcaattggcgcacgtaccaccgaatcgcaggtgcaccgcgaa<br>ctggcgtctggtctttcttgtccggtaggtttcaaaaatggcactgatggtacgattaaagtggc<br>tatcgatgccattaatgccgccggtgcgccgcactgcttcctgtccgtaacgaaatgggggc<br>attcggcgattgtgaataccagcggtaacggcgattgccatatcattctgcgcggcggtaaa<br>gagcctaactacagcgcgaagcacgttgctgaagtgaaagaagggctgaacaaagcagg<br>cctgccagcgcaggtgatgatcgatttcagccatgctaactcgtcaaaacaattcaaaaagc<br>agatggatgtttgtactgacgtttgccagcagattgccggtggcgaaaaggccattattggcg<br>tgatggtggaaagccatctggtggaaggcaatcagagcctcgagagcggggaaccgctg<br>gcctacggtaagagcatcaccgatgcctgcattggctgggatgataccgatgctctgttacgt<br>caactggcgagtgcagtaaaagcgcgtcgcgggtaaTACT<br><u>taagaaggagatatacat</u>atggcaaaggtatcgctggagaaagacaagattaagtttctgctg<br>gtagaaggcgtgcaccaaaaggcgctggaaagccttcgtgcagctggttacaccaacatcg<br>aatttcacaaaggcgctggatgatgaacaattaaaagaatccatccgcgatgcccacttc<br>atcggcctgcgatcccgtacccatctgactgaagacgtgatcaacgccgcagaaaaactgg<br>tcgctattggctgtttctgtatcggaacaaatcaggttgatctggatgcggcggcaaagcgcg<br>ggatcccggtatttaacgcaccgttctcaaatacgcgctctgttgcggagctggtgattggcg<br>aactgctgctgctattgcgcggcgtgccagaagccaatgctaaagcgcatcgtggcgtgtg<br>gaacaaactggcggcggttcttttgaagcgcgcggcaaaaagctgggtatcatcggctac<br>ggtcatattggtacgcaattgggcattctggctgaatcgctgggaatgtatgtttactttatgat<br>attgaaaacaaactgccgctgggcaacgccactcaggtacagcatctttctgacctgctgaat<br>atgagcgatgtggtgagtctgcatgtaccagagaatccgtccaccaaaaatgatgggcgc<br>gaaagagatttcgctaatgaagcccggctcgctgctgattaatgcttcgcgcggtactgtggt<br>ggatattccagcgctgtgtgacgcgctggcgagcaaacatctggcggggcggcaatcga<br>cgtattcccgacggaaccggcgaccaatagcgatccatttacctctccgctgtgtgaattcga<br>caatgtccttctgacgccacacattggcggttcgactcaggaagcgcaggagaatatcggct<br>tggaagttgcgggtaaattgatcaagtattctgacaatggctcaacgctctctgcggtgaactt<br>cccggaagtctcgctgccactgcacggtgggcgtcgtctgatgcacatccacgaaaaccgt<br>ccggggcgtgctaactgcgctcaacaaaattttttgccgagcagggcgtcaacatcgccgcg<br>caatatctacaaacttccgcccagatgggttatgtagttattgatattgaagccgacgaagacgt<br>tgccgaaaaagcgctgcaggcaatgaaagctattccgggtaccattcgcgcccgtctgctgt<br>actaa |
| SerA (RBS underlined)<br>SEQ ID NO: 254 | atggcaaaggtatcgctggagaaagacaagattaagtttctgctggtagaaggcgtgcacca<br>aaaggcgctggaaagccttcgtgcagctggttacaccaacatcgaatttcacaaaggcgcg<br>ctggatgatgaacaattaaaagaatccatccgcgatgcccactccatcggcctgcgatcccgt<br>acccatctgactgaagacgtgatcaacgccgcagaaaaactggtcgctattggctgtttctgt<br>atcggaacaaatcaggttgatctggatgcggcggcaaagcgcgggatcccggtatttaacg<br>caccgttctcaaatacgcgctctgttgcggagctggtgattggcgaactgctgctgctattgc<br>gcggcgtgccagaagccaatgctaaagcgcatcgtggcgtgtggaacaaactggcggcg<br>ggttcttttgaagcgcgcggcaaaaagctgggtatcatcggctacggtcatattggtacgcaa<br>ttgggcattctggctgaatcgctgggaatgtatgtttacttttatgatattgaaaacaaactgccg<br>ctgggcaacgccactcaggtacagcatctttctgacctgctgaatatgagcgatgtggtgagt<br>ctgcatgtaccagagaatccgtccaccaaaaatgatgggcgcgaaagagatttcgctaat<br>gaagcccggctcgctgctgattaatgcttcgcgcggtactgtggtggatattccagcgctgtg<br>tgacgcgctggcgagcaaacatctggcggggcggcaatcgacgtattcccgacggaac<br>cggcgaccaatagcgatccatttacctctccgctgtgtgaattcgacaatgtccttctgacgcc<br>acacattggcggttcgactcaggaagcgcaggagaatatcggcttggaagttgcgggtaaa<br>ttgatcaagtattctgacaatggctcaacgctctctgcggtgaacttcccggaagtctcgctgc<br>cactgcacggtgggcgtcgtctgatgcacatccacgaaaaccgtccgggcgtgctaactgc<br>gctcaacaaaattttttgccgagcagggcgtcaacatcgccgcgcaatatctacaaacttccg<br>cccagatgggttatgtagttattgatattgaagccgacgaagacgttgccgaaaaagcgctg<br>caggcaatgaaagctattccgggtaccattcgcgcccgtctgctgtactaa |
| fbrAroG-Tdc (tdc from C. roseus); RBS and leader region underlined<br>SEQ ID NO: 255 | <u>ctctagaaataattttgtttaactttaagaaggagatatacat</u>atgaattatcagaacgacgattt<br>acgcatcaaagaaatcaaagagttacttcctcctgtcgcattgctggaaaaattccccgctact<br>gaaaatgccgcgaatacggtcgcccatgcccgaaaagcgatccataagatcctgaaaggta<br>atgatgatcgcctgttggtggtgattggcccatgctcaattcatgatcctgtcgcggctaaaga<br>gtatgccactcgcttgctgacgctgcgtgaagagctgcaagatgagctggaaatcgtgatgc<br>gcgtctattttgaaaagccgcgtactacggtgggctggaaagggctgattaacgatccgcat<br>atggataacagcttccagatcaacgacggtctgcgtattgcccgcaaattgctgctcgatatta<br>cgacagcggtctgccagcggcgggtgaattcctggatatgatcaccctacaatatctcgct<br>gacctgatgagctggggcgcaattggcgcacgtaccaccgaatcgcaggtgcaccgcgaa |

| Description | Sequence |
|---|---|
| | ctggcgtctggtctttcttgtccggtaggtttcaaaaatggcactgatggtacgattaaagtggc<br>tatcgatgccattaatgccgccggtgcgccgcactgcttcctgtccgtaacgaaatgggggc<br>attcggcgattgtgaataccagcggtaacggcgattgccatatcattctgcgcggcggtaaa<br>gagcctaactacagcgcgaagcacgttgctgaagtgaaagaagggctgaacaaagcagg<br>cctgccagcgcaggtgatgatcgatttcagccatgctaactcgtcaaaacaattcaaaaagc<br>agatggatgtttgtactgacgtttgccagcagattgccggtggcgaaaaggccattattggcg<br>tgatggtggaaagccatctggtggaaggcaatcagagcctcgagagcggggaaccgctg<br>gcctacggtaagagcatcaccgatgcctgcattggctgggatgataccgatgctctgttacgt<br>caactggcgagtgcagtaaaagcgcgtcgcgggtaaTACTtaagaaggagatatacat<br>ATGGGTTCTATTGACTCGACGAATGTGGCCATGTCTAAT<br>TCTCCTGTTGGCGAGTTTAAGCCCCTTGAAGCAGAAGA<br>GTTCCGTAAACAGGCACACCGCATGGTGGATTTTATTGC<br>GGATTATTACAAGAACGTAGAAACATACCCGGTCCTTT<br>CCGAGGTTGAACCCGGCTATCTGCGCAAACGTATTCCC<br>GAAACCGCACCATACCTGCCGGAGCCACTTGATGATAT<br>TATGAAGGATATTCAAAAGGACATTATCCCCGGAATGA<br>CGAACTGGATGTCCCCGAACTTTTACGCCTTCTTCCCGG<br>CCACAGTTAGCTCAGCAGCTTTCTTGGGGGAAATGCTTT<br>CAACGGCCCTTAACAGCGTAGGATTTACCTGGGTCAGT<br>TCCCCGGCAGCGACTGAATTAGAGATGATCGTTATGGA<br>TTGGCTTGCGCAAATTTTGAAACTTCCAAAAAGCTTTAT<br>GTTCTCCGGAACCGGGGGTGGTGTCATCCAAAACACTA<br>CGTCAGAGTCGATCTTGTGCACTATTATCGCGGCCCGTG<br>AACGCGCCTTGGAAAAATTGGGCCCTGATTCAATTGGT<br>AAGCTTGTCTGCTATGGGTCCGATCAAACGCACACAAT<br>GTTTCCGAAAACCTGTAAGTTAGCAGGAATTTATCCGA<br>ATAATATCCGCCTTATCCCTACCACGGTAGAAACCGACT<br>TTGGCATCTCACCGCAGGTACTTCGCAAGATGGTCGAA<br>GACGACGTCGCTGCGGGGTACGTTCCCTTATTTTTGTGT<br>GCCACCTTGGGAACGACATCAACTACGGCAACAGATCC<br>TGTAGATTCGCTGTCCGAAATCGCAAACGAGTTTGGTAT<br>CTGGATTCATGTCGACGCCGCATATGCTGGATCGGCTTG<br>CATCTGCCCAGAATTTCGTCACTACCTTGATGGCATCGA<br>ACGTGTGGATTCCTTATCGCTGTCTCCCCACAAATGGCT<br>TTTAGCATATCTGGATTGCACGTGCTTGTGGGTAAAACA<br>ACCTCACCTGCTGCTTCGCGCTTTAACGACTAATCCCGA<br>ATACTTGAAGAATAAACAGAGTGATTTAGATAAGGTCG<br>TGGATTTTAAGAACTGGCAGATCGCAACAGGACGTAAG<br>TTCCGCTCTTTAAAACTTTGGTTAATTCTGCGTTCCTACG<br>GGGTAGTTAACCTGCAAAGTCATATCCGTAGTGATGTA<br>GCGATGGGGAAGATGTTTGAGGAATGGGTCCGTTCCGA<br>TAGCCGCTTTGAAATCGTCGTGCCACGTAATTTTTCGCT<br>TGTATGCTTTCGCTTGAAACCGGATGTATCTAGTTTACA<br>TGTCGAGGAGGTCAACAAGAAGTTGTTGGATATGCTTA<br>ACTCCACCGGTCGCGTATATATGACGCATACAATTGTTG<br>GCGGAATCTATATGTTACGTTTGGCTGTAGGTAGCAGCT<br>TGACAGAGGAACATCACGTGCGCCGCGTTTGGGACTTG<br>ATCCAGAAGCTTACGGACGACCTGCTTAAAGAGGCGTGA |
| Tdc (tdc from *C. roseus*)<br>SEQ ID NO: 256 | ATGGGTTCTATTGACTCGACGAATGTGGCCATGTCTAAT<br>TCTCCTGTTGGCGAGTTTAAGCCCCTTGAAGCAGAAGA<br>GTTCCGTAAACAGGCACACCGCATGGTGGATTTTATTGC<br>GGATTATTACAAGAACGTAGAAACATACCCGGTCCTTT<br>CCGAGGTTGAACCCGGCTATCTGCGCAAACGTATTCCC<br>GAAACCGCACCATACCTGCCGGAGCCACTTGATGATAT<br>TATGAAGGATATTCAAAAGGACATTATCCCCGGAATGA<br>CGAACTGGATGTCCCCGAACTTTTACGCCTTCTTCCCGG<br>CCACAGTTAGCTCAGCAGCTTTCTTGGGGGAAATGCTTT<br>CAACGGCCCTTAACAGCGTAGGATTTACCTGGGTCAGT<br>TCCCCGGCAGCGACTGAATTAGAGATGATCGTTATGGA<br>TTGGCTTGCGCAAATTTTGAAACTTCCAAAAAGCTTTAT<br>GTTCTCCGGAACCGGGGGTGGTGTCATCCAAAACACTA<br>CGTCAGAGTCGATCTTGTGCACTATTATCGCGGCCCGTG<br>AACGCGCCTTGGAAAAATTGGGCCCTGATTCAATTGGT<br>AAGCTTGTCTGCTATGGGTCCGATCAAACGCACACAAT<br>GTTTCCGAAAACCTGTAAGTTAGCAGGAATTTATCCGA<br>ATAATATCCGCCTTATCCCTACCACGGTAGAAACCGACT<br>TTGGCATCTCACCGCAGGTACTTCGCAAGATGGTCGAA<br>GACGACGTCGCTGCGGGGTACGTTCCCTTATTTTTGTGT<br>GCCACCTTGGGAACGACATCAACTACGGCAACAGATCC<br>TGTAGATTCGCTGTCCGAAATCGCAAACGAGTTTGGTAT<br>CTGGATTCATGTCGACGCCGCATATGCTGGATCGGCTTG<br>CATCTGCCCAGAATTTCGTCACTACCTTGATGGCATCGA<br>ACGTGTGGATTCCTTATCGCTGTCTCCCCACAAATGGCT<br>TTTAGCATATCTGGATTGCACGTGCTTGTGGGTAAAACA<br>ACCTCACCTGCTGCTTCGCGCTTTAACGACTAATCCCGA<br>ATACTTGAAGAATAAACAGAGTGATTTAGATAAGGTCG |

| Description | Sequence |
|---|---|
| | TGGATTTTAAGAACTGGCAGATCGCAACAGGACGTAAG<br>TTCCGCTCTTTAAAACTTTGGTTAATTCTGCGTTCCTACG<br>GGGTAGTTAACCTGCAAAGTCATATCCGTAGTGATGTA<br>GCGATGGGGAAGATGTTTGAGGAATGGGTCCGTTCCGA<br>TAGCCGCTTTGAAATCGTCGTGCCACGTAATTTTTCGCT<br>TGTATGCTTTCGCTTGAAACCGGATGTATCTAGTTTACA<br>TGTCGAGGAGGTCAACAAGAAGTTGTTGGATATGCTTA<br>ACTCCACCGGTCGCGTATATATGACGCATACAATTGTTG<br>GCGGAATCTATATGTTACGTTTGGCTGTAGGTAGCAGCT<br>TGACAGAGGAACATCACGTGCGCCGCGTTTGGGACTTG<br>ATCCAGAAGCTTACGGACGACCTGCTTAAAGAGGCGTGA |
| fbrArG-trpDH-ipdC-iad1<br>(RBS and leader region<br>underlined)<br>SEQ ID NO: 257 | <u>Ctctagaaataatttgtttaactttaagaaggagatatacat</u><br>atgaattatcagaacgacgatttacgcatcaaagaaatcaaagagttacttcctcctgtcgcatt<br>gctggaaaaattcccgctactgaaaatgccgcgaatacggtcgcccatgcccgaaaagcg<br>atccataagatcctgaaaggtaatgatgatcgcctgttggtggtgattggcccatgctcaattc<br>atgatcctgtcgcggctaaagagtatgccactcgcttgctgacgctgcgtgaagagctgcaa<br>gatgagctggaaatcgtgatgcgcgtctattttgaaaagccgcgtactacggtgggctggaa<br>agggctgattaacgatccgcatatggataacagcttccagatcaacgacggtctgcgtattgc<br>ccgcaaattgctgctcgatattaacgacagcggtctgccagcggcgggtgaattcctggata<br>tgatcaccctacaatatctcgctgacctgatgagctggggcgcaattggcgcacgtaccacc<br>gaatcgcaggtgcaccgcgaactggcgtctggtctttcttgtccggtaggtttcaaaaatggc<br>actgatggtacgattaaagtggctatcgatgccattaatgccgccggtgcgccgcactgcttc<br>ctgtccgtaacgaaatgggggcattcggcgattgtgaataccagcggtaacggcgattgcc<br>atatcattctgcgcggcggtaaagagcctaactacagcgcgaagcacgttgctgaagtgaa<br>agaagggctgaacaaagcaggcctgccagcgcaggtgatgatcgatttcagccatgctaac<br>tcgtcaaaacaattcaaaaagcagatggatgtttgtactgacgtttgccagcagattgccggt<br>ggcgaaaaggccattattggcgtgatggtggaaagccatctggtggaaggcaatcagagc<br>ctcgagagcggggaaccgctggcctacggtaagagcatcaccgatgcctgcattggctgg<br>gatgataccgatgctctgttacgtcaactggcgagtgcagtaaaagcgcgtcgcgggtaaT<br>ACT<u>taagaaggagatatacat</u>ATGCTGTTATTCGAGACTGTGCGTG<br>AAATGGGTCATGAGCAAGTCCTTTTCTGTCATAGCAAG<br>AATCCCGAGATCAAGGCAATTATCGCAATCCACGATAC<br>CACCTTAGGACCGGCTATGGGCGCAACTCGTATCTTACC<br>TTATATTAATGAGGAGGCTGCCCTGAAAGATGCATTAC<br>GTCTGTCCCGCGGAATGACTTACAAAGCAGCCTGCGCC<br>AATATTCCCGCCGGGGCGGCAAAGCCGTCATCATCGC<br>TAACCCCGAAAACAAGACCGATGACCTGTTACGCGCAT<br>ACGGCCGTTTCGTGGACAGCTTGAACGGCCGTTTCATCA<br>CCGGGCAGGACGTTAACATTACGCCCGACGACGTTCGC<br>ACTATTTCGCAGGAGACTAAGTACGTGGTAGGCGTCTC<br>AGAAAAGTCGGGAGGGCCGGCACCTATCACCTCTCTGG<br>GAGTATTTTTAGGCATCAAAGCCGCTGTAGAGTCGCGTT<br>GGCAGTCTAAACGCCTGGATGGCATGAAAGTGGCGGTG<br>CAAGGACTTGGGAACGTAGGAAAAAATCTTTGTCGCCA<br>TCTGCATGAACACGATGTACAACTTTTTGTGTCTGATGT<br>CGATCCAATCAAGGCCGAGGAAGTAAAACGCTTATTCG<br>GGGCGACTGTTGTCGAACCGACTGAAATCTATTCTTTAG<br>ATGTTGATATTTTTGCACCGTGTGCACTTGGGGGTATTT<br>TGAATAGCCATACCATCCCGTTCTTACAAGCCTCAATCA<br>TCGCAGGAGCAGCGAATAACCAGCTGGAGAACGAGCA<br>ACTTCATTCGCAGATGCTTGCGAAAAAGGGTATTCTTTA<br>CTCACCAGACTACGTTATCAATGCAGGAGGACTTATCA<br>ATGTTTATAACGAAATGATCGGATATGACGAGGAAAAA<br>GCATTCAAACAAGTTCATAACATCTACGATACGTTATTA<br>GCGATTTTCGAAATTGCAAAAGAACAAGGTGTAACCAC<br>CAACGACGCGGCCCGTCGTTTAGCAGAGGATCGTATCA<br>ACAACTCCAAACGCTCAAAGAGTAAAGCGATTGCGGCG<br>TGAAATGt<u>aagaaggagatatacat</u>ATGCGTACACCCTACTGTGT<br>CGCCGATTATCTTTTAGATCGTCTGACGGACTGCGGGGC<br>CGATCACCTGTTTGGCGTACCGGGCGATTACAACTTGCA<br>GTTTCTGGACCACGTCATTGACTCACCAGATATCTGCTG<br>GGTAGGGTGTGCGAACGAGCTTAACGCGAGCTACGCTG<br>CTGACGGATATGCGCGTTGTAAAGGCTTTGCTGCACTTC<br>TTACTACCTTCGGGGTCGGTGAGTTATCGGCGATGAAC<br>GGTATCGCAGGCTCGTACGCTGAGCACGTCCCGGTATT<br>ACACATTGTGGGAGCTCCGGGTACCGCAGCTCAACAGC<br>GCGGAGAACTGTTACACCACACGCTGGGCGACGGAGAA<br>TTCCGCCACTTTTACCATATGTCCGAGCCAATTACTGTA<br>GCCCAGGCTGTACTTACAGAGCAAAATGCCTGTTACGA<br>GATCGACCGTGTTTTGACCACGATGCTTCGCGAGCGCC<br>GTCCCGGGTATTTGATGCTGCCAGCCGATGTTGCCAAA<br>AAAGCTGCGACGCCCCCAGTGAATGCCCTGACGCATAA<br>ACAAGCTCATGCCGATTCCGCCTGTTTAAAGGCTTTTCG<br>CGATGCAGCTGAAAATAAATTAGCCATGTCGAAACGCA<br>CCGCCCTTGTTGGCGGACTTTTCTGGTCCTGCGCCATGGCC<br>TTAAACACGCCCTTCAGAAATGGGTCAAAGAAGTCCCG |

| Description | Sequence |
|---|---|
| | ATGGCCCACGCTACGATGCTTATGGGTAAGGGGATTTTT |
| | GATGAACGTCAAGCGGGATTTTATGGAACTTATTCCGG |
| | TTCGGCGAGTACGGGGGCGGTAAAGGAAGCGATTGAG |
| | GGAGCCGACACAGTTCTTTGCGTGGGGACACGTTTCAC |
| | CGATACACTGACCGCTGGATTCACACACCAACTTACTCC |
| | GGCACAAACGATTGAGGTGCAACCCCATGCGGCTCGCG |
| | TGGGGGATGTATGGTTTACGGGCATTCCAATGAATCAA |
| | GCCATTGAGACTCTTGTCGAGCTGTGCAAACAGCACGT |
| | CCACGCAGGACTGATGAGTTCGAGCTCTGGGGCGATTC |
| | CTTTTCCACAACCAGATGGTAGTTTAACTCAAGAAAACT |
| | TCTGGCGCACATTGCAAACCTTTATCCGCCCAGGTGATA |
| | TCATCTTAGCAGACCAGGGTACTTCAGCCTTTGGAGCA |
| | ATTGACCTGCGCTTACCAGCAGACGTGAACTTTATTGTG |
| | CAGCCGCTGTGGGGGTCTATTGGTTATACTTTAGCTGCG |
| | GCCTTCGGAGCGCAGACAGCGTGTCCAAACCGTCGTGT |
| | GATCGTATTGACAGGAGATGGAGCAGCGCAGTTGACCA |
| | TTCAGGAGTTAGGCTCGATGTTACGCGATAAGCAGCAC |
| | CCCATTATCCTGGTCCTGAACAATGAGGGGTATACAGTT |
| | GAACGCGCCATTCATGGTGCGGAACAACGCTACAATGA |
| | CATCGCTTTATGGAATTGGACGCACATCCCCCAAGCCTT |
| | ATCGTTAGATCCCCAATCGGAATGTTGGCGTGTGTCTGA |
| | AGCAGAGCAACTGGCTGATGTTCTGGAAAAAGTTGCTC |
| | ATCATGAACGCCTGTCGTTGATCGAGGTAATGTTGCCCA |
| | AGGCCGATATCCCTCCGTTACTGGGAGCCTTGACCAAG |
| | GCTTTAGAAGCCTGCAACAACGCTTAAAGGTtaa<u>gaaggagat</u> |
| | <u>atacat</u>ATGCCCACCTTGAACTTGGACTTACCCAACGGTAT |
| | TAAGAGCACGATTCAGGCAGACCTTTTCATCAATAATA |
| | AGTTTGTGCCGGCGCTTGATGGGAAAACGTTCGCAACT |
| | ATTAATCCGTCTACGGGGAAAGAGATCGGACAGGTGGC |
| | AGAGGCTTCGGCGAAGGATGTGGATCTTGCAGTTAAGG |
| | CCGCGCGTGAGGCGTTTGAAACTACTTGGGGGGAAAAC |
| | ACGCCAGGTGATGCTCGTGGCCGTTTACTGATTAAGCTT |
| | GCTGAGTTGGTGGAAGCGAATATTGATGAGTTAGCGGC |
| | AATTGAATCACTGGACAATGGGAAAGCGTTCTCTATTG |
| | CTAAGTCATTCGACGTAGCTGCTGTGGCCGCAAACTTAC |
| | GTTACTACGGCGGTTGGGCTGATAAAAACCACGGTAAA |
| | GTCATGGAGGTAGACACAAAGCGCCTGAACTATACCCG |
| | CCACGAGCCGATCGGGGTTTGCGGACAAATCATTCCGT |
| | GGAATTTCCCGCTTTTGATGTTTGCATGGAAGCTGGGTC |
| | CCGCTTTAGCCACAGGGAACACAATTGTGTTAAAGACT |
| | GCCGAGCAGACTCCCTTAAGTGCTATCAAGATGTGTGA |
| | ATTAATCGTAGAAGCCGGCTTTCCGCCCGGAGTAGTTA |
| | ATGTGATCTCGGGATTCGGACCGGTGGCGGGGGCCGCG |
| | ATCTCGCAACACATGGACATCGATAAGATTGCCTTTAC |
| | AGGATCGACATTGGTTGGCCGCAACATTATGAAGGCAG |
| | CTGCGTCGACTAACTTAAAAAAGGTTACACTTGAGTTA |
| | GGAGGAAAATCCCCGAATATCATTTTCAAAGATGCCGA |
| | CCTTGACCAAGCTGTTCGCTGGAGCGCCTTCGGTATCAT |
| | GTTTAACCACGGACAATGCTGCTGCGCTGGATCGCGCG |
| | TATATGTGGAAGAATCCATCTATGACGCCTTCATGGAA |
| | AAAATGACTGCGCATTGTAAGGCGCTTCAAGTTGGAGA |
| | TCCTTTCAGCGCGAACACCTTCCAAGGACCACAAGTCTC |
| | GCAGTTACAATACGACCGTATCATGGAATACATCGAAT |
| | CAGGGAAAAAGATGCAAATCTTGCTTTAGGCGGCGTT |
| | CGCAAAGGGAATGAGGGGTATTTCATTGAGCCAACTAT |
| | TTTTACAGACGTGCCGCACGACGCGAAGATTGCCAAAG |
| | AGGAGATCTTCGGTCCAGTGGTTGTTGTGTCGAAATTTA |
| | AGGACGAAAAAGATCTGATCCGTATCGCAAATGATTCT |
| | ATTTATGGTTTAGCTGCGGCAGTCTTTTCCCGCGACATC |
| | AGCCGCGCGATCGAGACAGCACACAAACTGAAAGCAG |
| | GCACGGTCTGGGTCAACTGCTATAATCAGCTTATTCCGC |
| | AGGTGCCATTCGGAGGGTATAAGGCTTCCGGTATCGGC |
| | CGTGAGTTGGGGGAATATGCCTTGTCTAATTACACAAA |
| | TATCAAGGCCGTCCACGTTAACCTTTCTCAACCGGCGCC |
| | CATTTGA |
| fbrARG (leader region and RBS underlined) SEQ ID NO: 258 | <u>Ctctagaaataattttgtttaactttaagaaggagatatacat</u>atgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttc |

| Description | Sequence |
|---|---|
| | ctgtccgtaacgaaatgggggcattcggcgattgtgaataccagcggtaacggcgattgcc<br>atatcattctgcgcggcggtaaagagcctaactacagcgcgaagcacgttgctgaagtgaa<br>agaagggctgaacaaagcaggcctgccagcgcaggtgatgatcgatttcagccatgctaac<br>tcgtcaaaacaattcaaaaagcagatggatgtttgtactgacgtttgccagcagattgccggt<br>ggcgaaaaggccattattggcgtgatggtggaaagccatctggtggaaggcaatcagagc<br>ctcgagagcggggaaccgctggcctacggtaagagcatcaccgatgcctgcattggctgg<br>gatgataccgatgctctgttacgtcaactggcgagtgcagtaaaagcgcgtcgcgggtaa |
| trpDH (RBS underlined)<br>SEQ ID NO: 259 | <u>Taagaaggagatatacat</u><br>ATGCTGTTATTCGAGACTGTGCGTGAAATGGGTCATGA<br>GCAAGTCCTTTTCTGTCATAGCAAGAATCCCGAGATCA<br>AGGCAATTATCGCAATCCACGATACCACCTTAGGACCG<br>GCTATGGGCGCAACTCGTATCTTACCTTATATTAATGAG<br>GAGGCTGCCCTGAAAGATGCATTACGTCTGTCCCGCGG<br>AATGACTTACAAAGCAGCCTGCGCCAATATTCCCGCCG<br>GGGGCGGCAAAGCCGTCATCATCGCTAACCCCGAAAAC<br>AAGACCGATGACCTGTTACGCGCATACGGCCGTTTCGT<br>GGACAGCTTGAACGGCCGTTTCATCACCGGGCAGGACG<br>TTAACATTACGCCCGACGACGTTCGCACTATTTCGCAGG<br>AGACTAAGTACGTGGTAGGCGTCTCAGAAAAGTCGGGA<br>GGGCCGGCACCTATCACCTCTCTGGGAGTATTTTTAGGC<br>ATCAAAGCCGCTGTAGAGTCGCGTTGGCAGTCTAAACG<br>CCTGGATGGCATGAAAGTGGCGGTGCAAGGACTTGGGA<br>ACGTAGGAAAAAATCTTTGTCGCCATCTGCATGAACAC<br>GATGTACAACTTTTTGTGTCTGATGTCGATCCAATCAAG<br>GCCGAGGAAGTAAAACGCTTATTCGGGGCGACTGTTGT<br>CGAACCGACTGAAATCTATTCTTTAGATGTTGATATTTT<br>TGCACCGTGTGCACTTGGGGGTATTTTGAATAGCCATAC<br>CATCCCGTTCTTACAAGCCTCAATCATCGCAGGAGCAG<br>CGAATAACCAGCTGGAGAACGAGCAACTTCATTCGCAG<br>ATGCTTGCGAAAAAGGGTATTCTTTACTCACCAGACTAC<br>GTTATCAATGCAGGAGGACTTATCAATGTTTATAACGA<br>AATGATCGGATATGACGAGGAAAAAGCATTCAAACAA<br>GTTCATAACATCTACGATACGTTATTAGCGATTTTCGAA<br>ATTGCAAAAGAACAAGGTGTAACCACCAACGACGCGGC<br>CCGTCGTTTAGCAGAGGATCGTATCAACAACTCCAAAC<br>GCTCAAAGAGTAAAGCGATTGCGGCGTGA |
| ipdC (RBS underlined)<br>SEQ ID NO: 260 | <u>gaaggagatatacat</u>ATGCGTACACCCTACTGTGTCGCCGATTA<br>TCTTTTAGATCGTCTGACGGACTGCGGGGCCGATCACCT<br>GTTTGGCGTACCGGGCGATTACAACTTGCAGTTTCTGGA<br>CCACGTCATTGACTCACCAGATATCTGCTGGGTAGGGT<br>GTGCGAACGAGCTTAACGCGAGCTACGCTGCTGACGGA<br>TATGCGCGTTGTAAAGGCTTTGCTGCACTTCTTACTACC<br>TTCGGGGTCGGTGAGTTATCGGCGATGAACGGTATCGC<br>AGGCTCGTACGCTGAGCACGTCCCGGTATTACACATTGT<br>GGGAGCTCCGGGTACCGCAGCTCAACAGCGCGGAGAAC<br>TGTTACACCACACGCTGGGCGACGGAGAATTCCGCCAC<br>TTTTACCATATGTCCGAGCCAATTACTGTAGCCCAGGCT<br>GTACTTACAGAGCAAAATGCCTGTTACGAGATCGACCG<br>TGTTTTGACCACGATGCTTCGCGAGCGCCGTCCCGGGTA<br>TTTGATGCTGCCAGCCGATGTTGCCAAAAAAGCTGCGA<br>CGCCCCCAGTGAATGCCCTGACGCATAAACAAGCTCAT<br>GCCGATTCCGCCTGTTTAAAGGCTTTTCGCGATGCAGCT<br>GAAAATAAATTAGCCATGTCGAAACGCACCGCCTTGTT<br>GGCGGACTTTCTGGTCCTGCGCCATGGCCTTAAACACGC<br>CCTTCAGAAATGGGTCAAAGAAGTCCCGATGGCCCACG<br>CTACGATGCTTATGGGTAAGGGGATTTTTGATGAACGTC<br>AAGCGGGATTTTATGGAACTTATTCCGGTTCGGCGAGT<br>ACGGGGGCGGTAAAGGAAGCGATTGAGGGAGCCGACA<br>CAGTTCTTTGCGTGGGGACACGTTTCACCGATACACTGA<br>CCGCTGGATTCACACACCAACTTACTCCGGCACAAACG<br>ATTGAGGTGCAACCCCATGCGGCTCGCGTGGGGGATGT<br>ATGGTTTACGGGCATTCCAATGAATCAAGCCATTGAGA<br>CTCTTGTCGAGCTGTGCAAACAGCACGTCCACGCAGGA<br>CTGATGAGTTCGAGCTCTGGGGCGATTCCTTTTCCACAA<br>CCAGATGGTAGTTTAACTCAAGAAAACTTCTGGCGCAC<br>ATTGCAAACCTTTATCCGCCCAGGTGATATCATCTTAGC<br>AGACCAGGGTACTTCAGCCTTTGGAGCAATTGACCTGC<br>GCTTACCAGCAGACGTGAACTTTATTGTGCAGCCGCTGT<br>GGGGGTCTATTGGTTATACTTTAGCTGCGGCCTTCGGAG<br>CGCAGACAGCGTGTCCAAACCGTCGTGTGATCGTATTG<br>ACAGGAGATGGAGCAGCGCAGTTGACCATTCAGGAGTT<br>AGGCTCGATGTTACGCGATAAGCAGCACCCCATTATCC<br>TGGTCCTGAACAATGAGGGGTATACAGTTGAACGCGCC<br>ATTCATGTGCGGAACAACGCTACAATGACATCGCTTT<br>ATGGAATTGGACGCACATCCCCCAAGCCTTATCGTTAG |

| Description | Sequence |
|---|---|
| | ATCCCCAATCGGAATGTTGGCGTGTGTCTGAAGCAGAG<br>CAACTGGCTGATGTTCTGGAAAAAGTTGCTCATCATGA<br>ACGCCTGTCGTTGATCGAGGTAATGTTGCCCAAGGCCG<br>ATATCCCTCCGTTACTGGGAGCCTTGACCAAGGCTTTAG<br>AAGCCTGCAACAACGCTTAA |
| Iad1 (RBS underlined)<br>SEQ ID NO: 261 | <u>gaaggagatatacat</u>ATGCCCACCTTGAACTTGGACTTACCCAA<br>CGGTATTAAGAGCACGATTCAGGCAGACCTTTTCATCA<br>ATAATAAGTTTGTGCCGGCGCTTGATGGGAAAACGTTC<br>GCAACTATTAATCCGTCTACGGGGAAAGAGATCGGACA<br>GGTGGCAGAGGCTTCGGCGAAGGATGTGGATCTTGCAG<br>TTAAGGCCGCGCGTGAGGCGTTTGAAACTACTTGGGGG<br>GAAAACACGCCAGGTGATGCTCGTGGCCGTTTACTGAT<br>TAAGCTTGCTGAGTTGGTGGAAGCGAATATTGATGAGT<br>TAGCGGCAATTGAATCACTGGACAATGGGAAAGCGTTC<br>TCTATTGCTAAGTCATTCGACGTAGCTGCTGTGGCCGCA<br>AACTTACGTTACTACGGCGGTTGGGCTGATAAAAACCA<br>CGGTAAAGTCATGGAGGTAGACACAAAGCGCCTGAACT<br>ATACCCGCCACGAGCCGATCGGGGTTTGCGGACAAATC<br>ATTCCGTGGAATTTCCCGCTTTTGATGTTTGCATGGAAG<br>CTGGGTCCCGCTTTAGCCACAGGGAACACAATTGTGTT<br>AAAGACTGCCGAGCAGACTCCCTTAAGTGCTATCAAGA<br>TGTGTGAATTAATCGTAGAAGCCGGCTTTCCGCCCGGA<br>GTAGTTAATGTGATCTCGGGATTCGGACCGGTGGCGGG<br>GGCCGCGATCTCGCAACACATGGACATCGATAAGATTG<br>CCTTTACAGGATCGACATTGGTTGGCCGCAACATTATGA<br>AGGCAGCTGCGTCGACTAACTTAAAAAAGGTTACACTT<br>GAGTTAGGAGGAAAATCCCCGAATATCATTTTCAAAGA<br>TGCCGACCTTGACCAAGCTGTTCGCTGGAGCGCCTTCG<br>TATCATGTTTAACCACGGACAATGCTGCTGCGCTGGATC<br>GCGCGTATATGTGGAAGAATCCATCTATGACGCCTTCAT<br>GGAAAAAATGACTGCGCATTGTAAGGCGCTTCAAGTTG<br>GAGATCCTTTCAGCGCGAACACCTTCCAAGGACCACAA<br>GTCTCGCAGTTACAATACGACCGTATCATGGAATACAT<br>CGAATCAGGGAAAAAAGATGCAAATCTTGCTTTAGGCG<br>GCGTTCGCAAAGGGAATGAGGGGTATTTCATTGAGCCA<br>ACTATTTTTACAGACGTGCCGCACGACGCGAAGATTGC<br>CAAAGAGGAGATCTTCGGTCCAGTGGTTGTTGTGTCGA<br>AATTTAAGGACGAAAAAGATCTGATCCGTATCGCAAAT<br>GATTCTATTTATGGTTTAGCTGCGGCAGTCTTTTCCCGC<br>GACATCAGCCGCGCGATCGAGACAGCACACAAACTGAA<br>AGCAGGCACGGTCTGGGTCAACTGCTATAATCAGCTTA<br>TTCCGCAGGTGCCATTCGGAGGGTATAAGGCTTCCGGT<br>ATCGGCCGTGAGTTGGGGGAATATGCCTTGTCTAATTAC<br>ACAAATATCAAGGCCGTCCACGTTAACCTTTCTCAACCG<br>GCGCCCATTTGA |
| TrpEDCBA (RBS and<br>leader region underlined)<br>SEQ ID NO: 262 | <u>Ctctagaaataatttttgtttaactttaagaaggagatatacat</u><br>atgcaaacacaaaaaccgactctcgaactgctaacctgcgaaggcgcttatcgcgacaacc<br>cgactgcgctttttcaccagttgtgtggggatcgtccgcaacgctgctgctggaatccgcag<br>atatcgacagcaaagatgatttaaaagcctgctgctggtagacagtgcgctcgcattaca<br>gcattaagtgacactgtcacaatccaggcgctttccggcaatggagaagccctgttgacact<br>actggataacgccttgcctgcgggtgtggaaatgaacaatcaccaaactgccgcgtactgc<br>gcttcccgcctgtcagtccactgctggatgaagacgcccgcttatgctccctttcggttttgac<br>gctttccgcttattacagaatctgttgaatgtaccgaaggaagaacgagaagcaatgttcttcg<br>gcggcctgttctcttatgaccttgtggcgggatttgaaaatttaccgcaactgtcagcggaaaa<br>tagctgccctgatttctgttttatctcgctgaaacgctgatggtgattgaccatcagaaaaaaa<br>gcactcgtattcaggccagcctgtttgctccgaatgaagaagaaaaacaacgtctcactgctc<br>gcctgaacgaactacgtcagcaactgaccgaagccgcgccgccgctgccggtggtttccgt<br>gccgcatatgcgttgtgaatgtaaccagagcgatgaagagtcggtggtgtagtgcgtttgtt<br>gcaaaaagcgattcgcgccggagaaattttccaggtggtgccatctcgccgtttctctctgcc<br>ctgcccgtcaccgctggcagcctattacgtgctgaaaaagagtaatcccagccgtacatgtt<br>ttttatgcaggataatgatttcaccctgtttggcgcgtcgccggaaagttcgctcaagtatgac<br>gccaccagccgccagattgagatttacccgattgccggaacacgtccacgcggtcgtcgtg<br>ccgatggttcgctggacagagacctcgacagccgcatcgaactggagatgcgtaccgatca<br>taaagagctttctgaacatctgatgctggtggatctcgcccgtaatgacctggcacgcattgc<br>acacccggcagccgctacgtcgccgatctcaccaaagttgaccgttactcttacgtgatgca<br>cctagtctcccgcgttgttggtgagctgcgccacgatctcgacgccctgcacgcttaccgcg<br>cctgtatgaatatggggacgttaagcggtgcaccgaaagtacgcgctatgcagttaattgcc<br>gaagcagaaggtcgtcgacgcggcagctacggcggcgcggtaggttattttaccgcgcat<br>ggcgatctcgacacctgcattgtgatccgctcggcgctggtggaaaacggtatcgccaccgt<br>gcaagccggtgctggcgtagtccttgattctgttcgtgaagccgacgaaactcgta<br>ataaagcccgcgctgtactgcgcgctattgccaccgcgcatcatgcacaggagacgttctaa<br>tggctgacattctgctgctcgataatatcgactcttttacgtacaacctggcagatcagttgcgc<br>agcaatggtcataacgtggtgatttaccgcaaccatattccggcgcagaccttaattgaacgc<br>ctggcgacgatgagcaatccggtgctgatgctttctcctggccccggtgtgccgagcgaag<br>ccggttgtatgccggaactcctcacccgcttgcgtggcaagctgccaattattggcatttgcct |

| Description | Sequence |
|---|---|
| | cggacatcaggcgattgtcgaagcttacggggctatgtcggtcaggcgggcgaaattcttc |
| | acggtaaagcgtcgagcattgaacatgacggtcaggcgatgtttgccggattaacaaaccc |
| | gctgccagtggcgcgttatcactcgctggttggcagtaacattccggccggtttaaccatcaa |
| | cgcccattttaatggcatggtgatggcggtgcgtcacgatgcagatcgcgtttgtggattca |
| | gttccatccggaatccattcttactacccaggcgctcgcctgctggaacaaacgctggcct |
| | gggcgcagcagaaactagagccaaccaacacgctgcaaccgattctgaaaaactgtatc |
| | aggcacagacgcttagccaacaagaaagccaccagctgttttcagcggtggtacgtggcga |
| | gctgaagccggaacaactggcggcggcgctggtgagcatgaaaattcgcggtgaacacc |
| | cgaacgagatcgccggggcagcaaccgcgctactggaaaacgccgcgccattcccgcgc |
| | ccggattatctgtttgccgatatcgtcggtactggcggtgacggcagcaacagcatcaatattt |
| | ctaccgccagtgcgtttgtcgccgcggcctgcgggctgaaagtggcgaaacacggcaacc |
| | gtagcgtctccagtaaatccggctcgtcggatctgctggcggcgttcggtattaatcttgatat |
| | gaacgccgataaatcgcgccaggcgctggatgagttaggcgtctgtttcctctttgcgccga |
| | agtatcacaccggattccgccatgcgatgccggttcgccagcaactgaaaacccgcactct |
| | gttcaacgtgctgggaccattgattaacccggcgcatccgccgctggcgctaattggtgtttat |
| | agtccggaactggtgctgccgattgccgaaaccttgcgcgtgctggggtatcaacgcgcgg |
| | cagtggtgcacagcggcgggatggatgaagtttcattacacgcgccgacaatcgttgccga |
| | actacatgacggcgaaattaagagctatcaattgaccgctgaagattttggcctgacaccta |
| | ccaccaggagcaattggcaggcggaacaccggaagaaaaccgtgacattttaacacgctt |
| | gttacaaggtaaaggcgacgccgcccatgaagcagccgtcgcggcgaatgtcgccatgtt |
| | aatgcgcctgcatggccatgaagatctgcaagccaatgcgcaaaccgttcttgaggtactgc |
| | gcagtggttccgcttacgacagagtcaccgcactggcggcacgagggtaaatgatgcaaa |
| | ccgttttagcgaaaatcgtcgcagacaaggcgatttgggtagaaacccgcaaagagcagca |
| | accgctggccagttttcagaatgaggttcagccggcacgcgacattttttatgatgcacttca |
| | gggcgcacgcacggcgtttattctggagtgtaaaaaagcgtcgccgtcaaaaggcgtgatc |
| | cgtgatgatttcgatccggcacgcattgccgccattttataaacattacgcttcggcaatttcagt |
| | gctgactgatgagaaatattttcaggggagctttgatttcctcccccatcgtcagccaaatcgcc |
| | ccgcagccgatttttatgtaaagacttcattatcgatccttaccagatctatctggcgcgctattac |
| | caggccgatgcctgcttattaatgctttcagtactggatgacgaacaatatcgccagcttgcag |
| | ccgtcgcccacagtctggagatgggtgtgctgaccgaagtcagtaatgaagaggaactgga |
| | gcgcgccattgcattgggggcaaaggtcgttggcatcaacaaccgcgatctgcgcgatttgt |
| | cgattgatctcaaccgtacccgcgagcttgcgccgaaactggggcacaacgtgacggtaat |
| | cagcgaatccggcatcaatacttacgctcaggtgcgcgagttaagccacttcgctaacggct |
| | ttctgattggttcggcgttgatggcccatgacgatttgaacgccgccgtgcgtcgggtgttgct |
| | gggtgagaataaagtatgtggcctgacacgtgggcaagatgctaaagcagcttatgacgcg |
| | ggcgcgatttacggtgggttgattttttgttgcgacatcaccgcgttgcgtcaacgttgaacagg |
| | cgcaggaagtgatggctgcagcaccgttgcagtatgttggcgtgttccgcaatcacgatattg |
| | ccgatgtggcggacaaagctaaggtgttatcgctggcggcagtgcaactgcatggtaatga |
| | agatcagctgtatatcgacaatctgcgtgaggctctgccagcacacgtcgccatctggaagg |
| | cttttaagtgtcggtgaaactcttcccgcgcgcgattttcagcacatcgataaatatgtattcgac |
| | aacggtcagggcgggagcggacaacgtttcgactggtcactattaaatggtcaatcgcttgg |
| | caacgttctgctggcggggggcttaggcgcagataactgcgtggaagcggcacaaaccgg |
| | ctgcgccgggcttgattttaattctgctgtagagtcgcaacccgggtatcaaagacgcacgtctt |
| | ttggcctcggttttccagacgctgcgcgcatattaaggaaaggaacaatgacaacattactta |
| | acccctattttggtgagtttggcggcatgtacgtgccacaaatcctgatgcctgctctgcgcca |
| | gctggaagaagctttttgtcagcgcgcaaaaagatcctgaatttcaggctcagttcaacgacct |
| | gctgaaaaactatgccgggcgtccaaccgcgctgaccaaatgccagaacattacagccgg |
| | gacgaacaccacgctgtatctgaagcgcgaagatttgctgcacggcggcgcgcataaaact |
| | aaccaggtgctcggtcaggctttactggcgaagcggatgggtaaaactgaaattattgccga |
| | aaccggtgccggtcagcatggcgtggcgtcggcccttgccagcgccctgctcggcctgaa |
| | atgccgaatttatatgggtgccaaagacgttgaacgccagtcgcccaacgttttccggatgcg |
| | cttaatgggtgcggaagtgatcccggtacatagcggttccgcgaccctgaaagatgcctgta |
| | atgaggcgctacgcgactggtccggcagttatgaaaccgcgcactatatgctgggtaccgc |
| | agctggcccgcatccttacccgaccattgtgcgtgagtttcagcggatgattggcgaagaaa |
| | cgaaagcgcagattctgaaagagaaggtcgcctgccggatgccgttatcgcctgtgttgg |
| | cggtggttcgaatgccatcggtatgtttgcagatttcatcaacgaaaccgacgtcggcctgatt |
| | ggtgtggagcctggccggccacggtatcgaaactggcgagcacggcgcaccgttaaaacat |
| | ggtcgcgtgggcatctatttcggtatgaaagcgccgatgatgcaaaccgaagacgggcaaa |
| | ttgaagagtcttactccatttctgccgggctggatttccccgtccgtcggcccgcaacatgcgta |
| | tctcaacagcactggacgcgctgattacgtgtctattaccgacgatgaagccctggaagcctt |
| | taaaacgctttgcctgcatgaagggatcatcccggcgctggaatcctcccacgccctggccc |
| | atgcgctgaaaatgatgcgcgaaaatccggaaaaagagcagctactggtggttaaccttttcc |
| | ggtcgcggcgataaagacatcttcaccgttcacgatattttgaaagcacgaggggaaatctg |
| | atggaacgctacgaatctctgtttgcccagttgaaggagcgcaaagaaggcgcattcgttcct |
| | ttcgtcaccctcggtgatccgggcattgagcagtcgttgaaaattatcgatacgctaattgaag |
| | ccggtgctgacgcgctggagttaggcatcccctctccgacccactggcggatggcccgac |
| | gattcaaaacgccacactgctgcttttgcggcgggagtaaccccgcgcagtgctttgaga |
| | tgctggcactcattcgccagaagcaccgaccattcccatcggccttttgatgtatgccaacct |
| | ggtgtttaacaaaggcattgatgagtttatgccgagtgcgagaaagtcggcgtcgattcggt |
| | gctggttgccgatgtgcccgtggaagagtccgcgcccttccgccaggccgcgttgcgtcat |
| | aatgtcgcacctatctttatttgcccgccgaatgccgacgatgatttgctgcgccagatagcct |
| | cttacggtcgtggttacacctatttgctgtcgcgagcggcgattgaccggcgcagaaaaccg |
| | cgccgcgttacccctcaatcatctggttgcgaagctgaaagagtacaacgctgcgcctccatt |
| | gcagggatttggtatttccgccccggatcaggtaaaagccgcgattgatgcaggagctgcg |
| | ggcgcgatttctggttccggccatcgttaaaatcatcgagcaacatattaatgagccagagaaa |
| | atgctggcggcactgaaagcttttgtacaaccgatgaaagcggcgacgcgcagtta |

-continued

| Description | Sequence |
|---|---|
| trpE<br>SEQ ID NO: 263 | atgcaaacacaaaaaccgactctcgaactgctaacctgcgaaggcgcttatcgcgacaacc<br>cgactgcgcttttttcaccagttgtgtggggatcgtccggcaacgctgctgctggaatccgcag<br>atatcgacagcaaagatgatttaaaaagcctgctgctggtagacagtgcgctgcgcattaca<br>gcattaagtgacactgtcacaatccaggcgctttccgcaatggagaagccctgttgacact<br>actggataacgccttgcctgcgggtgtggaaaatgaacaatcaccaaactgccgcgtactgc<br>gcttcccgcctgtcagtccactgctggatgaagacgcccgcttatgctccctttcggttttttgac<br>gctttccgcttattacagaatctgttgaatgtaccgaaggaagaacgagaagcaatgttcttcg<br>gcggcctgttctcttatgaccttgtggcgggatttgaaaatttaccgcaactgtcagcgaaaa<br>tagctgccctgatttctgttttatctcgctgaaacgctgatggtgattgaccatcagaaaaaaa<br>gcactcgtattcaggccagcctgtttgctccgaatgaagaagaaaaacaacgtctcactgctc<br>gcctgaacgaactacgtcagcaactgaccgaagccgcgccgccgctgccggtggtttccgt<br>gccgcatatgcgttgtgaatgtaaccagagcgatgaagagttcggtggtgtagtgcgtttgtt<br>gcaaaaagcgattcgcgccgagaaattttccaggtggtgccatctcgccgtttctctctgcc<br>ctgcccgtcaccgctggcagccattacgtgctgaaaaagagtaatcccagcccgtacatgtt<br>ttttatgcaggataatgatttcaccctgtttggcgcgtcgccggaaagttcgctcaagtatgac<br>gccaccagccgccagattgagatttacccgattgccggaacacgtccacgcggtcgtcgtg<br>ccgatggttcgctggacagagacctcgacagccgcatcgaactggagatgcgtaccgatca<br>taaagagctttctgaacatctgatgctggtggatctcgcccgtaatgacctggcacgcatttgc<br>acacccggcagccgctacgtcgccgatctcaccaaagttgaccgttactcttacgtgatgca<br>cctagtctcccgcgttgttggtgagctgcgccacgatctcgacgccctgcacgcttaccgcg<br>cctgtatgaatatggggacgttaagcggtgcaccgaaagtacgcgctatgcagttaattgcc<br>gaagcagaaggtcgtcgacgcggcagctacggcggcgcggtaggttatttttaccgcgcat<br>ggcgatctcgacacctgcattgtgatccgctcggcgctggtggaaaacggtatcgccaccgt<br>gcaagccggtgctggcgtagtccttgattctgttccgcagtcggaagccgacgaaactcgta<br>ataaagcccgcgctgtactgcgcgctattgccaccgcgcatcatgcacaggagacgttcta |
| trpD<br>SEQ ID NO: 264 | atggctgacattctgctgctcgataatatcgactcttttacgtacaacctggcagatcagttgcg<br>cagcaatggtcataacgtggtgatttaccgcaaccattccggcgcagacttaattgaacg<br>cctggcgacgatgagcaatccggtgctgatgctttctcctggccccgtgtgccgagcgaa<br>gccggttgtatgccggaactcctcacccgcttgcgtggcaagctgccaattattggcatttgc<br>ctcggacatcaggcgattgtcgaagcttacgggggctatgtcggtcaggcgggcgaaattct<br>tcacggtaaagcgtcgagcattgaacatgacggtcaggcgatgtttgccgattaacaaacc<br>cgctgccagtggccgcgttatcactcgctggttggcagtaacattccggccggtttaaccatca<br>acgcccattttaatggcatggtgatggcggtgcgtcacgatgcagatcgcgtttgtggattcc<br>agttccatccggaatccattcttactacccagggcgctcgcctgctggaacaaacgctggcct<br>gggcgcagcagaaactagagccaaccaaacacgctgcaaccgattctggaaaaactgtatc<br>aggcacagacgcttagccaacaagaaagccaccagctgttttcagcggtggtacgtggcga<br>gctgaagccggaacaactggcggcggcgctggtgagcatgaaaattcgcggtgaacacc<br>cgaacgagatcgccggggcagcaaccgcgctactggaaaacgccgcgccattcccgcgc<br>ccggattatctgtttgccgatatcgtcggtactggcggtgacggcagcaacagcatcaatatt<br>ctaccgccagtgcgtttgtcgccgcggcctgcgggctgaaagtggcgaaacacggcaacc<br>gtagcgtctccagtaaatccggctcgtcggatctgctggcggcgttcggtattaatcttgatat<br>gaacgccgataaatcgcgccaggcgctggatgagttaggcgtctgtttcctctttgcgccga<br>agtatcacaccggattccgccatgcgatgccggttcgccagcaactgaaaaaaccgcactct<br>gttcaacgtgctgggaccattgattaacccggcgcatccgccgctggcgctaattggtgtttat<br>agtccggaactggtgctgccgattgccgaaaccttgcgcgtgctggggtatcaacgcgcgg<br>cagtggtgcacagcggcgggatggatgaagtttcattacacgcgccgacaatcgttgccga<br>actacatgacggcgaaattaagagctatcaattgaccgctgaagattttggcctgacaccta<br>ccaccaggagcaattggcaggcggaacaccggaagaaaaccgtgacattttaacacgctt<br>gttacaaggtaaaggcgacgccgcccatgaagcagccgtcgcggcgaatgtcgccatgtt<br>aatgcgcctgcatggccatgaagatctgcaagccaatgcgcaaaccgttcttgaggtactgc<br>gcagtggttccgcttacgacagagtcaccgcactggcggcacgagggtaa |
| trpC<br>SEQ ID NO: 265 | atgcaaaccgttttagcgaaaatcgtcgcagacaaggcgatttgggtagaaacccgcaaag<br>agcagcaaccgctggccagttttcagaatgaggttcagccgagcacgcgacatttttatgatg<br>cacttcagggcgcacgcacggcgttattctggagtgtaaaaaagcgtcgccgtcaaaagg<br>cgtgatccgtgatgatttcgatccggcacgcattgccgccatttataaacattacgcttcggca<br>atttcagtgctgactgatgagaaatattttcaggggagctttgatttcctcccatcgtcagcca<br>aatcgccccgcagccgatttatgtaaagacttcattatcgatccttaccagatctatctggcgc<br>gctattaccaggccgatgcctgcttattaatgctttcagtactggatgacgaacaatatcgcca<br>gcttcagccgtcgcccacagtctggagatgggtgtgctgaccgaagtcagtaatgaagag<br>gaactggagcgcgccattgcattgggggcaaaggtcgttggcatcaacaaccgcgatctgc<br>gcgatttgtcgattgatctcaaccgtacccgcgagcttgcgccgaaactggggcacaacgtg<br>acggtaatcagcgaatccggcatcaatacttacgtcaggtgcgcgagttaagccacttcgc<br>taacggctttctgattggttcggcgttgatggccatgacgatttgaacgccgccgtgcgtcg<br>ggtgttgctgggtgagaataaagtatgtggcctgacacgtgggcaagatgctaaagcagctt<br>atgacgcgggcgcgatttacggtgggttgatttttgttgcgacatcaccgcgttgcgtcaacgt<br>tgaacaggcgcaggaagtgatggctgcagcaccgttgcagtatgttggcgtgttccgcaatc<br>acgatattgccgatgtggcggacaaagctaaggtgttatcgctggcggcagtgcaactgcat<br>ggtaatgaagatcagctgtatatcgacaatctgcgtgaagtctgccagcacacgtcgccat<br>ctggaaggctttaagtgtcggtgaaactcttcccgcgcgcgatttttcagcacatcgataaatat<br>gtattcgacaacggtcagggcgggagcggacaacgtttcgactggtcactattaaatggtca<br>atcgcttggcaacgttctgctggcggggggcttaggcgcagataactgcgtggaagcggca<br>caaaccggctgcgccgggcttgatttttaattctgctgtagagtcgcaaccgggtatcaaagac<br>gcacgtctttttggcctcggttttccagacgctgcgcgcatattaa |

| Description | Sequence |
| --- | --- |
| trpB<br>SEQ ID NO: 266 | atgacaacattacttaacccctattttggtgagtttggcggcatgtacgtgccacaaatcctgat<br>gcctgctctgcgccagctggaagaagctttgtcagcgcgcaaaaagatcctgaatttcagg<br>ctcagttcaacgacctgctgaaaaactatgccggcgtccaaccgcgctgaccaaatgcca<br>gaacattacagccgggacgaacaccacgctgtatctgaagcgcgaagattgctgcacggc<br>ggcgcgcataaaactaaccaggtgctcggtcaggctttactggcgaagcggatgggtaaaa<br>ctgaaattattgccgaaaccggtgccggtcagcatggcgtggcgtcggccctgccagcgc<br>cctgctcggcctgaaatgccgaatttatatgggtgccaaagacgttgaacgccagtcgccca<br>acgttttccggatgcgcttaatgggtgcggaagtgatcccggtacatagcggttccgcgacc<br>ctgaaagatgcctgtaatgaggcgctacgcgactggtccggcagttatgaaaccgcgcact<br>atatgctgggtaccgcagctggcccgcatccttacccgaccattgtgcgtgagtttcagcgg<br>atgattggcgaagaaacgaaagcgcagattctggaaagaaaaggtcgcctgccggatgcc<br>gttatcgcctgtgttggcggtggttcgaatgccatcggtatgtttgcagatttcatcaacgaaac<br>cgacgtcggcctgattggtgtggagcctggcggccacggtatcgaactggcgagcacgg<br>cgcaccgttaaaacatggtcgcgtgggcatctatttcggtatgaaagcgccgatgatgcaaa<br>ccgaagacgggcaaattgaagagtcttactccattctgccgggctggatttcccgtccgtcg<br>gcccgcaacatgcgtatctcaacagcactggacgcgctgattacgtgtctattaccgacgat<br>gaagccctggaagcctttaaaacgctttgcctgcatgaagggatcatcccggcgctggaatc<br>ctcccacgccctggcccatgcgctgaaaatgatgcgcgaaaatccggaaaaagagcagct<br>actggtggttaaccttttccggtcgcggcgataaagacatcttcaccgttcacgatattttgaaa<br>gcacgagggaaatctg |
| trpA<br>SEQ ID NO: 267 | atggaacgctacgaatctctgtttgcccagttgaaggagcgcaaagaaggcgcattcgttcct<br>ttcgtcaccctcggtgatccgggcattgagcagtcgttgaaaattatcgatacgctaattgaag<br>ccggtgctgacgcgctggagttaggcatcccctctccgacccactggcggatggcccgac<br>gattcaaaacgccacactgcgtgctttttgcggcgggagtaaccccggcgcagtgctttgaga<br>tgctggcactcattcgccagaagcacccgaccattccatcggccttttgatgtatgccaacct<br>ggtgtttaacaaaggcattgatgagttttatgccgagtgcgagaaagtcggcgctcgattcggt<br>gctggttgccgatgtgcccgtgaagagtccgcgcccttccgccaggccgcgttgcgtcat<br>aatgtcgcacctatctttatttgcccgccgaatgccgacgatgatttgctgcgccagatagcct<br>cttacggtcgtggttacacctatttgctgtcgcgagcgggcgtgaccggcgcagaaaaccg<br>cgccgcgttacccctcaatcatctggttgcgaagctgaaaagagtacaacgctgcgcctccatt<br>gcagggatttggtatttccgccccggatcaggtaaaagccgcgattgatgcaggagctgcg<br>ggcgcgatttctggttcggccatcgttaaaatcatcgagcaacatattaatgagccagagaaa<br>atgctggcggcactgaaagcttttgtacaaccgatgaaagcggcgacgcgcagttaa |
| fbrS40FTrpE-DCBA<br>(leader region and RBS<br>underlined)<br>SEQ ID NO: 268 | <u>ctctagaaataatttgtttaactttaagaaggagatatacat</u>atgcaaacacaaaaaccgactc<br>tcgaactgctaacctgcgaaggcgcttatcgcgacaacccgactgcgcttttttcaccagttgt<br>gtggggatcgtccggcaacgctgctgctggaattcgcagatatcgacagcaaagatgattta<br>aaaagcctgctgctggtagacagtgcgctgcgcattacagcattaagtgacactgtcacaat<br>ccaggcgctttccggcaatggagaagccctgttgacactactggataaccgccttgcctgcgg<br>gtgtggaaaatgaacaatcaccaaactgccgcgtactgcgcttcccgcctgtcagtccactg<br>ctggatgaagacgcccgcttatgctccctttcggttttttgacgcttttccgcttattacagaatctg<br>ttgaatgtaccgaaggaagaacgagaagcaatgttcttcggcggcctgttctcttatgaccttg<br>tggcgggatttgaaaatttaccgcaactgtcagcggaaaatagctgccctgatttctgttttttat<br>ctcgctgaaacgctgatggtgattgaccatcagaaaaaaaagcactcgtattcaggccagcct<br>gtttgctccgaatgaagaagaaaaacaacgtctcactgctcgcctgaacgaactacgtcagc<br>aactgaccgaagccgcgccgccgctgccggtggtttccgtgccgcatatgcgttgtgaatgt<br>aaccagagcgatgaagagttcggtggtgtagtgcgtttgttgcaaaaagcgattcgcgccgg<br>agaaattttccaggtggtgccatctcgccgtttctctctgccctgcccgtcaccgctggcagcc<br>tattacgtgctgaaaagagtaatcccagcccgtacatgtttttttatgcaggataatgatttcac<br>cctgtttggcgcgtcgcggaaagttcgctcaagtatgacgccaccagccgccagattgag<br>atttacccgattgccggaacacgtccacgcggtcgtcgtgccgatggttcgctggacagaga<br>cctcgacagccgcatcgaactggagatgcgtaccgatcataaagagctttctgaacatctgat<br>gctggtggatctcgcccgtaatgacctggcacgcatttgcacaccccggcagccgctacgtc<br>gccgatctcaccaaagttgaccgttactcttacgtgatgcacctagtctcccgcgttgttggtg<br>agctgcgccacgatctcgacgccctgcacgcttaccgcgcctgtatgaatatggggacgtta<br>agcggtgcaccgaaagtacgcgctatgcagttaattgccgaagcagaaggtcgtcgacgc<br>ggcagctacggcggcgcggtaggttattttaccgcgcatggcgatctcgacacctgcattgt<br>gatccgctcggcgctggtggaaaacggtatcgccaccgtgcaagccggtgctggcgtagt<br>ccttgattctgttccgcagtcggaagccgacgaaactcgtaataaagcccgcgctgtactgc<br>gcgctattgccaccgcgcatcatgcacaggagacgttctaatggctgacattctgctgctcga<br>taatatcgactcttttacgtacaacctggcagatcagttgcgcagcaatggtcataacgtggtg<br>atttaccgcaaccatattccggcgcagaccttaattgaacgcctggcgacgatgagcaatcc<br>ggtgctgatgctttctcctggccccggtgtgccgagcgaagccggttgtatgccggaactcc<br>tcacccgcttgcgtggcaagctgccaattattggcatttgcctcggacatcaggcgattgtcg<br>aagcttacgggggctatgtcggtcaggcgggcgaaattcttcacggtaaagcgtcgagcatt<br>gaacatgacggtcaggcgatgtttgccggattaacaaaccccgtgccagtggcgcgttatca<br>ctcgctgttggcagtaacattccggccggtttaaccatcaacgccattttaatggcatggtg<br>atggcggtgcgtcacgatgcagatcgctttgtggattccagttccatccggaatccattctta<br>ctacccagggcgctcgcctgctggaacaaacgctggcctgggcgcagcagaaactagag<br>ccaaccaacacgctgcaccgattctgaaaaactgtatcaggcacagacgcttagccaac<br>aagaaagccaccagctgtttttcagcggtggtacgtggcgagctgaagccggaacaactgg<br>cggcggcgctggtgagcatgaaaattcgcggtgaacacccgaacgagatcgccggggca<br>gcaaccgcgctactgaaaacgccgcgccattcccgcgcccggattatctgtttgccgatat<br>cgtcggtactggcggtgacgcagcaacagcatcaatatttctaccgccagtgcgtttgtcg<br>ccgcggccgcgcggctgaaagtggcgaaacacggcaaccgtagcgtctccagtaaatccg |

| Description | Sequence |
|---|---|
| | gctcgtcggatctgctggcggcgttcggtattaatcttgatatgaacgccgataaatcgcgcc |
| | aggcgctggatgagttaggcgtctgtttcctctttgcgccgaagtatcacaccggattccgcc |
| | atgcgatgccggttcgccagcaactgaaaacccgcactctgttcaacgtgctgggaccattg |
| | attaaccggcgcatccgccgctggcgctaattggtgtttatagtccggaactggtgctgccg |
| | attgccgaaaccttgcgcgtgctggggtatcaacgcgcggcagtggtgcacagcggcggg |
| | atggatgaagtttcattacacgcgccgacaatcgttgccgaactacatgacggcgaaattaa |
| | gagctatcaattgaccgctgaagattttggcctgacaccctaccaccaggagcaattggcag |
| | gcggaacaccggaagaaaaccgtgacattttaacacgcttgttacaaggtaaaggcgacgc |
| | cgcccatgaagcagccgtcgcggcgaatgtcgccatgttaatgcgcctgcatggccatgaa |
| | gatctgcaagccaatgcgcaaaccgttcttgaggtactgcgcagtggttccgcttacgacag |
| | agtcaccgcactggcggcacgagggtaaatgatgcaaaccgttttagcgaaaatcgtcgca |
| | gacaaggcgatttgggtagaaaaccgcaaagagcagcaaccgctggccagttttcagaatg |
| | aggttcagccgagcacgcgacatttttatgatgcacttcagggcgcacgcacggcgtttattc |
| | tggagtgtaaaaaagcgtcgccgtcaaaaggcgtgatccgtgatgatttcgatccggcacgc |
| | attgccgccatttataaacattacgcttcggcaatttcagtgctgactgatgagaaatattttcag |
| | gggagctttgatttcctccccatcgtcagccaaatcgccccgcagccgattttatgtaaagact |
| | tcattatcgatccttaccagatctatctggcgcgctattaccaggccgatgcctgcttattaatg |
| | ctttcagtactggatgacgaacaatatcgccagcttgcagccgtcgcccacagtctggagat |
| | gggtgtgctgaccgaagtcagtaatgaagaggaactggagcgcgccattgcattgggggc |
| | aaaggtcgttggcatcaacaaccgcgatctcgcgcgatttgtcgattgatctcaaccgtacccg |
| | cgagcttgcgccgaaactggggcacaacgtgacggtaatcagcgaatccggcatcaatact |
| | tacgctcaggtcgcgcgagttaagccacttcgctaacgcgctttctgattggttcggcgttgatgg |
| | cccatgacgatttgaacgccgccgtgcgtcgggtgttgctgggtgagaataaagtatgtggc |
| | ctgacacgtgggcaagatgctaaagcagcttatgacgcgggcgcgatttacggtgggttgat |
| | ttttgttgcgacatcaccgcgttgcgtcaacgttgaacaggcgcaggaagtgatggctgcag |
| | caccgttgcagtatgttggcgtgttccgcaatcacgatattgccgatgtggcggacaaagcta |
| | aggtgttatcgctggcggcagtgcaactgcatggtaatgaagatcagctgtatatcgacaatc |
| | tgcgtgaggctctgccagcacacgtcgccatctggaaggctttaagtgtcggtgaaactcttc |
| | ccgcgcgcgattttcagcacatcgataaatatgtattcgacaacggtcagggcgggagcgg |
| | acaacgtttcgactggtcactattaaatggtcaatcgcttggcaacgttctgctggcgggggg |
| | cttaggcgcagataactgcgtggaagcggcacaaaccggctgcgccgggcttgattttaatt |
| | ctgctgtagagtcgcaaccgggtatcaaagacgacgtcttttggcctcggttttccagacgc |
| | tgcgcgcatattaaggaaaggaacaatgacaacattacttaaccccctatttttggtgagtttggc |
| | ggcatgtacgtgccacaaatcctgatgcctgctctgcgccagctggaagaagctttgtcagc |
| | gcgcaaaaagatcctgaatttcaggctcagttcaacgacctgctgaaaaactatgccgggcg |
| | tccaaccgcgctgaccaaatgccagaacattacagccgggacgaacaccacgctgtatctg |
| | aagcgcgaagatttgctgcacggcggcgcataaaactaaccaggtgctcggtcaggctt |
| | tactggcgaagcggatgggtaaaactgaaattattgccgaaaccggtgccggtcagcatgg |
| | cgtggcgtcggcccttgccagcgccctgctcggcctgaaatgccgaatttatatgggtgcca |
| | aagacgttgaacgccagtcgcccaacgttttccggatgcgcttaatgggtgcggaagtgatc |
| | ccggtacatagcggttccgcgaccctgaaagatgctgtaatgaggcgctacgcgactggt |
| | ccggcagttatgaaaccgcgcactatatgctgggtaccgcagctggccccgcatccttacccg |
| | accattgtgcgtgagtttcagcggatgattggcgaagaaacgaaagcgcagattctggaaa |
| | gagaaggtcgcctgccggatgccgttatcgcctgtgttggcggtggttcgaatgccatcggt |
| | atgtttgcagatttcatcaacgaaaccgacgtcggcctgattggtgtggagcctggcggcca |
| | cggtatcgaaactggcgagcacggcgcaccgttaaaacatggtcgcgtgggcatctatttcg |
| | gtatgaaagcgccgatgatgcaaaccgaagacgggcaaattgaagagtcttactccatttct |
| | gccgggctggatttcccgtccgtcggcccgcaacatgcgtatctcaacagcactggacgcg |
| | ctgattacgtgtctattaccgacgatgaagccctggaagcctttaaaacgctttgcctgcatga |
| | agggatcatcccggcgctggaatcctcccacgccctggcccatgcgctgaaaatgatgcgc |
| | gaaaatccggaaaaagagcagctactggtggttaaccttccggtcgcggcgataaagcaca |
| | tcttcaccgttcacgatattttgaaagcacgaggggaaatctgatggaacgctacgaatctctg |
| | tttgcccagttgaaggagcgcaaagaaggcgcattcgttccttttcgtcaccctcggtgatccg |
| | ggcattgagcagtcgttgaaaattatcgatacgctaattgaagcggtgctgacgcgctgga |
| | gttaggcatcccccttctccgacccactggcggatggcccgacgattcaaaacgccacactg |
| | cgtgcttttgcggcgggagtaaccccggcgcagtgctttgagatgctggcactcattcgcca |
| | gaagcacccgaccattcccatcggccttttgatgtatgcaaccttggtgtttaacaaaggcatt |
| | gatgagttttatgccgagtgcgagaaagtcggcgtcgattcggtcggttgccgatgtgccc |
| | gtggaagagtccgcgcccttccgccaggccgcgttgcgtcataatgtcgcacctatctttattt |
| | gcccgccgaatgccgacgatgatttgctgcgccagatagcctcttacggtcgtggttacacct |
| | atttgctgtcgcgagcgggcgtgaccggcgcagaaaaccgcgccgcgttaccctcaatca |
| | tctggttgcgaagctgaaagagtacaacgctgcgcctccattgcagggatttggtatttccgc |
| | cccggatcaggtaaaagccgcgattgatgcaggagctgcgggcgcgatttctggttcggcc |
| | atcgttaaaatcatcgagcaacatattaatgagccagagaaatgctggcggcactgaaagc |
| | ttttgtacaaccgatgaaagcggcgacgcgcagttaa |
| fbrTrpE<br>SEQ ID NO: 269 | atgcaaacacaaaaaccgactctcgaactgctaacctgcgaaggcgcttatcgcgacaacc |
| | cgactgcgcttttttcaccagttgtgtggggatcgtccggcaacgctgctgctggaattcgcag |
| | atatcgacagcaaagatgatttaaaaagcctgctgctggtagacagtgcgctgcgcattaca |
| | gcattaagtgacactgtcacaatccaggcgctttccggcaatggagaagcctgttgacact |
| | actggataacgccttgcctgcgggtgtggaaatgaacaatcaccaaactgccgcgtactgc |
| | gcttcccgcctgtcagtccactgctggatgaagacgcgcttatgctcccttcggttttttgac |
| | gcttttccgcttattacgaatctgttgaatgtaccgaaggaagaacgagaagcaatgttcttcg |
| | gcggcctgttctcttatgaccttgtggcgggatttgaaaatttaccgcaactgtcagggaaaa |
| | tagctgccctgatttctgttttatctcgctgaaacgctgatggtgattgaccatcagaaaaaaa |
| | gcactcgtattcaggccagcctgtttgctccgaatgaagaagaaaaacaacgtctcactgctc |
| | gcctgaacgaactacgtcagcaactgaccgaagccgcgccgccgctgccggtggtttccgt |

| Description | Sequence |
|---|---|
| | gccgcatatgcgttgtgaatgtaaccagagcgatgaagagttcggtggtgtagtgcgtttgtt |
| | gcaaaaagcgattcgcgccggagaaattttccaggtggtgccatctcgccgtttctctctgcc |
| | ctgcccgtcaccgctggcagcctattacgtgctgaaaaagagtaatcccagcccgtacatgtt |
| | ttttatgcaggataatgatttcaccctgtttggcgcgtcgccggaaagttcgctcaagtatgac |
| | gccaccagccgccagattgagatttacccgattgccggaacacgtccacgcggtcgtcgtg |
| | ccgatggttcgctggacagagacctcgacagccgcatcgaactggagatgcgtaccgatca |
| | taaagagctttctgaacatctgatgctggtggatctcgcccgtaatgacctggcacgcatttgc |
| | acacccggcagccgctacgtcgccgatctcaccaaagttgaccgttactcttacgtgatgca |
| | cctagtctcccgcgttgttggtgagctgcgccacgatctcgacgccctgcacgcttaccgcg |
| | cctgtatgaatatggggacgttaagcggtgcaccgaaagtacgcgctatgcagttaattgcc |
| | gaagcagaaggtcgtcgacgcggcagctacggcggcgcggtaggttattttaccgcgcat |
| | ggcgatctcgacacctgcattgtgatccgctcggcgctggtggaaaacggtatcgccaccgt |
| | gcaagccggtgctggcgtagtccttgattctgttccgcagtcggaagccgacgaaactcgta |
| | ataaagcccgcgctgtactgcgcgctattgccaccgcgcatcatgcacaggagacgttcta |
| trpDH-fldABCDacuIfldH (leader region and RBS underlined) SEQ ID NO: 270 | <u>ctctagaaataattttgtttaactttaagaaggagatatacat</u>atgaattatcagaacgacgattt |
| | acgcatcaaagaaatcaaagagttacttcctcctgtcgcattgctggaaaaattccccgctact |
| | gaaaatgccgcgaatacggtcgcccatgcccgaaaagcgatccataagatcctgaaaggta |
| | atgatgatcgcctgttggtggtgattggcccatgctcaattcatgatcctgtcgcggctaaaga |
| | gtatgccactcgcttgctgacgctgcgtgaagagctgcaagatgagctggaaatcgtgatgc |
| | gcgtctatttttgaaaagccgcgtactacggtgggctggaaagggctgattaacgatccgcat |
| | atggataacagcttccagatcaacgacggtctgcgtattgcccgcaaattgctgctcgatatta |
| | acgacagcggtctgccagcggcgggtgaattcctggatatgatcaccctacaatatctcgct |
| | gacctgatgagctggggcgcaattggcgcacgtaccaccgaatcgcaggtgcaccgcgaa |
| | ctggcgtctggtctttcttgtccggtaggtttcaaaaatggcactgatggtacgattaaagtggc |
| | tatcgatgccattaatgccgccggtgcgccgcactgcttcctgtccgtaacgaaatgggggc |
| | attcggcgattgtgaataccagcggtaacggcgattgccatatcattctgcgcggcggtaaa |
| | gagcctaactacagcgcgaagcacgttgctgaagtgaaagaagggctgaacaaagcagg |
| | cctgccagcgcaggtgatgatcgatttcagccatgctaactcgtcaaaacaattcaaaaagc |
| | agatggatgtttgtactgacgtttgccagcagattgccggtggcgaaaaggccattattggcg |
| | tgatggtggaaagccatctggtggaaggcaatcagagcctcgagagcggggaaccgctg |
| | gcctacggtaagagcatcaccgatgcctgcattggctgggatgataccgatgctctgttacgt |
| | caactggcgagtgcagtaaaaagcgcgtcgcgggtaaTACT<u>taagaaggagatatacat</u> |
| | ATGCTGTTATTCGAGACTGTGCGTGAAATGGGTCATGA |
| | GCAAGTCCTTTTCTGTCATAGCAAGAATCCCGAGATCA |
| | AGGCAATTATCGCAATCCACGATACCACCTTAGGACCG |
| | GCTATGGGCGCAACTCGTATCTTACCTTATATTAATGAG |
| | GAGGCTGCCCTGAAAGATGCATTACGTCTGTCCCGCGG |
| | AATGACTTACAAAGCAGCCTGCGCCAATATTCCCGCCG |
| | GGGGCGGCAAAGCCGTCATCATCGCTAACCCCGAAAAC |
| | AAGACCGATGACCTGTTACGCGCATACGGCCGTTTCGT |
| | GGACAGCTTGAACGGCCGTTTCATCACCGGGCAGGACG |
| | TTAACATTACGCCCGACGACGTTCGCACTATTTCGCAGG |
| | AGACTAAGTACGTGGTAGGCGTCTCAGAAAAGTCGGGA |
| | GGGCCGGCCACCTATCCACCTCTCTGGGAGTATTTTAGGC |
| | ATCAAAGCCGCTGTAGAGTCGCGTTGGCAGTCTAAACG |
| | CCTGGATGGCATGAAAGTGGCGGTGCAAGGACTTGGGA |
| | ACGTAGGAAAAAATCTTTGTCGCCATCTGCATGAACAC |
| | GATGTACAACTTTTTGTGTCTGATGTCGATCCAATCAAG |
| | GCCGAGGAAGTAAAACGCTTATTCGGGGCGACTGTTGT |
| | CGAACCGACTGAAATCTATTCTTTAGATGTTGATATTTT |
| | TGCACCGTGTGCACTTGGGGGTATTTTGAATAGCCATAC |
| | CATCCCGTTCTTACAAGCCTCAATCATCGCAGGAGCAG |
| | CGAATAACCAGCTGGAGAACGAGCAACTTCATTCGCAG |
| | ATGCTTGCGAAAAAGGGTATTCTTTACTCACCAGACTAC |
| | GTTATCAATGCAGGAGGACTTATCAATGTTTATAACGA |
| | AATGATCGGATATGACGAGGAAAAAGCATTCAAACAA |
| | GTTCATAACATCTACGATACGTTATTAGCGATTTTCGAA |
| | ATTGCAAAAGAACAAGGTGTAACCACCAACGACGCGGC |
| | CCGTCGTTTAGCAGAGGATCGTATCAACAACTCCAAAC |
| | GCTCAAAGAGTAAAGCGATTGCGGCGTGAAATGt<u>aagaagg</u> |
| | <u>agatatacat</u>ATGGAAAACAACACCAATATGTTCTCTGGAGT |
| | GAAGGTGATCGAACTGGCCAACTTTATCGCTGCTCCGG |
| | CGGCAGGTCGCTTCTTTGCTGATGGGGGAGCAGAAGTA |
| | ATTAAGATCGAATCTCCAGCAGGCGACCCGCTGCGCTA |
| | CACGGCCCCATCAGAAGGACGCCCGCTTTCTCAAGAGG |
| | AAAACACAACGTATGATTTGGAAAACGCGAATAAGAA |
| | AGCAATTGTTCTGAACTTAAAATCGGAAAAAGGAAAGA |
| | AAATTCTTCACGAGATGCTTGCTGAGGCAGACATCTTGT |
| | TAACAAATTGGCGCACGAAAGCGTTAGTCAAACAGGGG |
| | TTAGATTACGAAACACTGAAAGAGAAGTATCCAAATT |
| | GGTATTTGCACAGATTACAGGATACGGGAGAAAGGAC |
| | CCGACAAAGACCTGCCTGGTTTCGACTACACGGCGTTTT |
| | TCGCCCGCGGAGGAGTCTCCGGTACATTATATGAAAAA |
| | GGAACTGTCCCTCCTAATGTGGTACCGGGTCTGGGTGA |
| | CCACCAGGCAGGAATGTTCTTAGCTGCCGGTATGGCTG |
| | GTGCGTTGTATAAGGCCAAAACCACCGGACAAGGCGAC |

| Description | Sequence |
|---|---|
| | AAAGTCACCGTTAGTCTGATGCATAGCGCAATGTACGG |
| | CCTGGGAATCATGATTCAGGCAGCCCAGTACAAGGACC |
| | ATGGGCTGGTGTACCCGATCAACCGTAATGAAACGCCT |
| | AATCCTTTCATCGTTTCATACAAGTCCAAAGATGATTAC |
| | TTTGTCCAAGTTTGCATGCCTCCCTATGATGTGTTTTATG |
| | ATCGCTTTATGACGGCCTTAGGACGTGAAGACTTGGTA |
| | GGTGACGAACGCTACAATAAGATCGAGAACTTGAAGGA |
| | TGGTCGCGCAAAAGAAGTCTATTCCATCATCGAACAAC |
| | AAATGGTAACGAAGACGAAGGACGAATGGGACAAGAT |
| | TTTTCGTGATGCAGACATTCCATTCGCTATTGCCCAAAC |
| | GTGGGAAGATCTTTTAGAAGACGAGCAGGCATGGGCCA |
| | ACGACTACCTGTATAAAATGAAGTATCCCACAGGCAAC |
| | GAACGTGCCCTGGTACGTTTACCTGTGTTCTTCAAAGAA |
| | GCTGGACTTCCTGAATACAACCAGTCGCCACAGATTGC |
| | TGAGAATACCGTGGAAGTGTTAAAGGAGATGGGATATA |
| | CCGAGCAAGAAATTGAGGAGCTTGAGAAAGACAAAGA |
| | CATCATGGTACGTAAAGAGAAATGAAGGTtaagaaggagatat |
| | acatATGTCAGACCGCAACAAAGAAGTGAAAGAAAAGAA |
| | GGCTAAACACTATCTGCGCGAGATCACAGCTAAACACT |
| | ACAAGGAAGCGTTAGAGGCTAAAGAGCGTGGGGAGAA |
| | AGTGGGTTGGTGTGCCTCTAACTTCCCCCAAGAGATTGC |
| | AACCACGTTGGGTGTAAAGGTTGTTTATCCCGAAAACC |
| | ACGCCGCCGCCGTAGCGGCACGTGGCAATGGGCAAAAT |
| | ATGTGCGAACACGCGGAGGCTATGGGATTCAGTAATGA |
| | TGTGTGTGGATATGCACGTGTAAATTTAGCCGTAATGG |
| | ACATCGGCCATAGTGAAGATCAACCTATTCCAATGCCT |
| | GATTTCGTTCTGTGCTGTAATAATATCTGCAATCAGATG |
| | ATTAAATGGTATGAACACATTGCAAAAACGTTGGATAT |
| | TCCTATGATCCTTATCGATATTCCATATAATACTGAGAA |
| | CACGGTGTCTCAGGACCGCATTAAGTACATCCGCGCCC |
| | AGTTCGATGACGCTATCAAGCAACTGGAAGAAATCACT |
| | GGCAAAAAGTGGGACGAGAATAAATTCGAAGAAGTGA |
| | TGAAGATTTCGCAAGAATCGGCCAAGCAATGGTTACGC |
| | GCCGCGAGCTACGCGAAATACAAACCATCCACCGTTTTC |
| | GGGCTTTGACCTTTTTAATCACATGGCTGTAGCCGTTTG |
| | TGCTCGCGGCACCCAGGAAGCCGCCGATGCATTCAAAA |
| | TGTTAGCAGATGAATATGAAGAGAACGTTAAGACAGGA |
| | AAGTCTACTTATCGCGGCGAGGAGAAGCAGCGTATCTT |
| | GTTCGAGGGCATCGCTTGTTGGCCTTATCTGCGCCACAA |
| | GTTGACGAAACTGAGTGAATATGGAATGAACGTCACAG |
| | CTACGGTGTACGCCGAAGCTTTTGGGGTTATTTACGAAA |
| | ACATGGATGAACTGATGGCCGCTTACAATAAAGTGCCT |
| | AACTCAATCTCCTTCGAGAACGCGCTGAAGATGCGTCTT |
| | AATGCCGTTACAAGCACCAATACAGAAGGGGCTGTTAT |
| | CCACATTAATCGCAGTTGTAAGCTGTGGTCAGGATTCTT |
| | ATACGAACTGGCCCGTCGTTTGGAAAAGGAGACGGGGA |
| | TCCCTGTTGTTTCGTTCGACGGAGATCAAGCGGATCCCC |
| | GTAACTTCTCCGAGGCTCAATATGACACTCGCATCCAA |
| | GGTTTAAATGAGGTGATGGTCGCGAAAAAAGAAGCAG |
| | AGTGAGCTTtaagaaggagatatacatATGTCGAATAGTGACAAG |
| | TTTTTTAACGACTTCAAGGACATTGTGGAAAACCCAAA |
| | GAAGTATATCATGAAGCATATGGAACAAACGGGACAA |
| | AAAGCCATCGGTTGCATGCCTTTATACACCCCAGAAGA |
| | GCTTGTCTTAGCGGCGGGTATGTTTCCTGTTGGAGTATG |
| | GGGCTCGAATACTGAGTTGTCAAAAGCCAAGACCTACT |
| | TTCCGGCTTTTATCTGTTCTATCTTGCAAACTACTTTAGA |
| | AAACGCATTGAATGGGGAGTATGACATGCTGTCTGGTA |
| | TGATGATCACAAACTATTGCGATTCGCTGAAATGTATG |
| | GGACAAAACTTCAAACTTACAGTGGAAAATATCGAATT |
| | CATCCCGGTTACGGTTCCACAAAACCGCAAGATGGAGG |
| | CGGGTAAAGAATTTCTGAAATCCCAGTATAAAATGAAT |
| | ATCGAACAACTGGAAAAATCTCAGGGAATAAGATCAC |
| | TGACGAGAGCTTGGAGAAGGCTATTGAAATTTACGATG |
| | AGCACCGTAAAGTCATGAACGATTTCTCTATGCTTGCGT |
| | CCAAGTACCCTGGTATCATTACGCCAACGAAACGTAAC |
| | TACGTGATGAAGTCAGCGTATTATATGGACAAGAAAGA |
| | ACATACAGAGAAGGTACGTCAGTTGATGGATGAAATCA |
| | AGGCCATTGAGCCTAAACCATTCGAAGGAAAACGCGTG |
| | ATTACCACTGGGATCATTGCAGATTCGGAGGACCTTTTG |
| | AAAATCTTGGAGGAGAATAACATTGCTATCGTGGGAGA |
| | TGATATTGCACACGAGTCTCGCCAATACCGCACTTTGAC |
| | CCCGGAGGCCAACACACCTATGGACCGTCTTGCTGAAC |
| | AATTTGCGAACCGCGAGTGTTCGACGTTGTATGACCCTG |
| | AAAAAAAACGTGGACAGTATATTGTCGAGATGGCAAAA |
| | GAGCGTAAGGCCGACGGAATCATCTTCTTCATGACAAA |
| | ATTCTGCGATCCCGAAGAATACGATTACCCTCAGATGA |
| | AAAAAGACTTCGAAGAAGCCGGTATTCCCCACGTTCTG |

| Description | Sequence |
| --- | --- |
| | ATTGAGACAGACATGCAAATGAAGAACTACGAACAAG<br>CTCGCACCGCTATTCAAGCATTTTCAGAAACCCTTTGAC<br>GCTtaagaaggagatatacatATGCGTGCTGTCTTAATCGAGAAG<br>TCAGATGACACCCAGAGTGTTTCAGTTACGGAGTTGGC<br>TGAAGACCAATTACCCGAAGGTGACGTCCTTGTGGATG<br>TCGCGTACAGCACATTGAATTACAAGGATGCTCTTGCG<br>ATTACTGGAAAAGCACCCGTTGTACGCCGTTTTCCTATG<br>GTCCCCGGAATTGACTTTACTGGGACTGTCGCACAGAG<br>TTCCCATGCTGATTTCAAGCCAGGCGACCGCGTAATTCT<br>GAACGGATGGGGAGTTGGTGAGAAACACTGGGGCGGT<br>CTTGCAGAACGCGCACGCGTACGTGGGGACTGGCTTGT<br>CCCGTTGCCAGCCCCCTTAGACTTGCGCCAGGCTGCAAT<br>GATTGGCACTGCGGGGTACACAGCTATGCTGTGCGTGC<br>TTGCCCTTGAGCGCCATGGAGTCGTACCTGGGAACGGC<br>GAGATTGTCGTCTCAGGCGCAGCAGGAGGGGTAGGTTC<br>TGTAGCAACCACACTGTTAGCAGCCAAAGGCTACGAAG<br>TGGCCGCCGTGACCGGGCGCGCAAGCGAGGCCGAATAT<br>TTACGCGGATTAGGCGCCGCGTCGGTCATTGATCGCAA<br>TGAATTAACGGGGAAGGTGCGTCCATTAGGGCAGGAAC<br>GCTGGGCAGGAGGAATCGATGTAGCAGGATCAACCGTA<br>CTTGCTAATATGTTGAGCATGATGAAATACCGTGGCGT<br>GGTGGCGGCCTGTGGCCTGGCGGCTGGAATGGACTTGC<br>CCGCGTCTGTCGCCCCTTTTATTCTGCGTGGTATGACTTT<br>GGCAGGGGTAGATTCAGTCATGTGCCCCAAAACTGATC<br>GTCTGGCTGCTTGGGCACGCCTGGCATCCGACCTGGAC<br>CCTGCAAAGCTGGAAGAGATGACAACTGAATTACCGTT<br>CTCTGAGGTGATTGAAACGGCTCCGAAGTTCTTGGATG<br>GAACAGTGCGTGGGCGTATTGTCATTCCGGTAACACCTT<br>GATACTtaagaaggagatatacatATGAAAATCTTGGCATACTGC<br>GTCCGCCCAGACGAGGTAGACTCCTTTAAGAAATTTAG<br>TGAAAAGTACGGGCATACAGTTGATCTTATTCCAGACT<br>CTTTTGGACCTAATGTCGCTCATTTGGCGAAGGGTTACG<br>ATGGGATTTCTATTCTGGGCAACGACACGTGTAACCGT<br>GAGGCACTGGAGAAGATCAAGGATTGCGGGATCAAAT<br>ATCTGGCAACCCGTACAGCCGGAGTGAACAACATTGAC<br>TTCGATGCAGCAAAGGAGTTCGGTATTAACGTGGCTAA<br>TGTTCCCGCATATTCCCCCAACTCGGTCAGCGAATTTAC<br>CATTGGATTGGCATTAAGTCTGACGCGTAAGATTCCATT<br>TGCCCTGAAACGCGTGGAACTGAACAATTTTGCGCTTG<br>GCGGCCTTATTGGTGTGGAATTGCGTAACTTAACTTTAG<br>GAGTCATCGGTACTGGTCGCATCGGATTGAAAGTGATT<br>GAGGGCTTCTCTGGGTTTGGAATGAAAAAAAATGATCGG<br>TTATGACATTTTTGAAAATGAAGAAGCAAAGAAGTACA<br>TCGAATACAAATCATTAGACGAAGTTTTTAAAGAGGCT<br>GATATTATCACTCTGCATGCGCCTCTGACAGACGACAA<br>CTATCATATGATTGGTAAAGAATCCATTGCTAAAATGA<br>AGGATGGGGTATTTATTATCAACGCAGCGCGTGGAGCC<br>TTAATCGATAGTGAGGCCCTGATTGAAGGGTTAAAATC<br>GGGGAAGATT |
| fldA<br>SEQ ID NO: 271 | ATGGAAAACAACACCAATATGTTCTCTGGAGTGAAGGT<br>GATCGAACTGGCCAACTTTATCGCTGCTCCGGCGGCAG<br>GTCGCTTCTTTGCTGATGGGGGAGCAGAAGTAATTAAG<br>ATCGAATCTCCAGCAGGCGACCCGCTGCGCTACACGGC<br>CCCATCAGAAGGACGCCCGCTTTCTCAAGAGGAAAACA<br>CAACGTATGATTTGGAAAACGCGAATAAGAAAGCAATT<br>GTTCTGAACTTAAAATCGGAAAAAGGAAAGAAAATTCT<br>TCACGAGATGCTTGCTGAGGCAGACATCTTGTTAACAA<br>ATTGGCGCACGAAAGCGTTAGTCAAACAGGGGTTAGAT<br>TACGAAACACTGAAAGAGAAGTATCCAAAATTGGTATT<br>TGCACAGATTACAGGATACGGGGAGAAAGGACCCGAC<br>AAAGACCTGCCTGGTTTCGACTACACGGCGTTTTTCGCC<br>CGCGGAGGAGTCTCCGGTACATTATATGAAAAAGGAAC<br>TGTCCCTCCTAATGTGGTACCGGGTCTGGGTGACCACCA<br>GGCAGGAATGTTCTTAGCTGCCGGTATGGCTGGTGCGTT<br>GTATAAGGCCAAAACCACCGGACAAGGCGACAAAGTC<br>ACCGTTAGTCTGATGCATAGCGCAATGTACGGCCTGGG<br>AATCATGATTCAGGCAGCCCAGTACAAGGACCATGGGC<br>TGGTGTACCCGATCAACCGTAATGAAACGCCTAATCCTT<br>TCATCGTTTCATACAAGTCCAAAGATGATTACTTTGTCC<br>AAGTTTGCATGCCTCCCTATGATGTGTTTTATGATCGCT<br>TTATGACGGCCTTAGGACGTGAAGACTTGGTAGGTGAC<br>GAACGCTACAATAAGATCGAGAACTTGAAGGATGGTCG<br>CGCAAAAGAAGTCTATTCCATCATCGAACAACAAATGG<br>TAACGAAGACGAAGGACGAATGGGACAAGATTTTTCGT<br>GATGCAGACATTCCATTCGCTATTGCCCAAACGTGGGA<br>AGATCTTTTAGAAGACGAGCAGGCATGGGCCAACGACT |

| Description | Sequence |
|---|---|
| | ACCTGTATAAAATGAAGTATCCCACAGGCAACGAACGT<br>GCCCTGGTACGTTTACCTGTGTTCTTCAAAGAAGCTGGA<br>CTTCCTGAATACAACCAGTCGCCACAGATTGCTGAGAA<br>TACCGTGGAAGTGTTAAAGGAGATGGGATATACCGAGC<br>AAGAAATTGAGGAGCTTGAGAAAGACAAAGACATCAT<br>GGTACGTAAAGAGAAATGA |
| fldB<br>SEQ ID NO: 278 | ATGTCAGACCGCAACAAAGAAGTGAAAGAAAAGAAGG<br>CTAAACACTATCTGCGCGAGATCACAGCTAAACACTAC<br>AAGGAAGCGTTAGAGGCTAAAGAGCGTGGGGAGAAAG<br>TGGGTTGGTGTGCCTCTAACTTCCCCCAAGAGATTGCAA<br>CCACGTTGGGTGTAAAGGTTGTTTATCCCGAAAACCAC<br>GCCGCCGCCGTAGCGGCACGTGGCAATGGGCAAAATAT<br>GTGCGAACACGCGGAGGCTATGGGATTCAGTAATGATG<br>TGTGTGGATATGCACGTGTAAATTTAGCCGTAATGGAC<br>ATCGGCCATAGTGAAGATCAACCTATTCCAATGCCTGA<br>TTTCGTTCTGTGCTGTAATAATATCTGCAATCAGATGAT<br>TAAATGGTATGAACACATTGCAAAAACGTTGGATATTC<br>CTATGATCCTTATCGATATTCCATATAATACTGAGAACA<br>CGGTGTCTCAGGACCGCATTAAGTACATCCGCGCCCAG<br>TTCGATGACGCTATCAAGCAACTGGAAGAAATCACTGG<br>CAAAAAGTGGGACGAGAATAAATTCGAAGAAGTGATG<br>AAGATTTCGCAAGAATCGGCCAAGCAATGGTTACGCGC<br>CGCGAGCTACGCGAAATACAAACCATCACCGTTTTCGG<br>GCTTTGACCTTTTTAATCACATGGCTGTAGCCGTTTGTG<br>CTCGCGGCACCCAGGAAGCCGCCGATGCATTCAAAATG<br>TTAGCAGATGAATATGAAGAACGTTAAGACAGGAA<br>AGTCTACTTATCGCGGCGAGGAGAAGCAGCGTATCTTG<br>TTCGAGGGCATCGCTTGTTGGCCTTATCTGCGCCACAAG<br>TTGACGAAACTGAGTGAATATGGAATGAACGTCACAGC<br>TACGGTGTACGCCGAAGCTTTTGGGGTTATTTACGAAA<br>ACATGGATGAACTGATGGCCGCTTACAATAAAGTGCCT<br>AACTCAATCTCCTTCGAGAACGCGCTGAAGATGCGTCTT<br>AATGCCGTTACAAGCACCAATACAGAAGGGGCTGTTAT<br>CCACATTAATCGCAGTTGTAAGCTGTGGTCAGGATTCTT<br>ATACGAACTGGCCCGTCGTTTGGAAAAGGAGACGGGGA<br>TCCCTGTTGTTTCGTTCGACGGAGATCAAGCGGATCCCC<br>GTAACTTCTCCGAGGCTCAATATGACACTCGCATCCAA<br>GGTTTAAATGAGGTGATGGTCGCGAAAAAGAAGCAG<br>AGTGA |
| fldC<br>SEQ ID NO: 279 | ATGTCGAATAGTGACAAGTTTTTTAACGACTTCAAGGA<br>CATTGTGGAAAACCCAAAGAAGTATATCATGAAGCATA<br>TGGAACAAACGGGACAAAAAGCCATCGGTTGCATGCCT<br>TTATACACCCCAGAAGAGCTTGTCTTAGCGGCGGGTAT<br>GTTTCCTGTTGGAGTATGGGGCTCGAATACTGAGTTGTC<br>AAAAGCCAAGACCTACTTTCCGGCTTTTATCTGTTCTAT<br>CTTGCAAACTACTTTAGAAAACGCATTGAATGGGGAGT<br>ATGACATGCTGTCTGGTATGATGATCACAAACTATTGCG<br>ATTCGCTGAAATGTATGGGACAAAACTTCAAACTTACA<br>GTGGAAAATATCGAATTCATCCCGGTTACGGTTCCACA<br>AAACCGCAAGATGGAGGCGGGTAAAGAATTTCTGAAAT<br>CCCAGTATAAAATGAATATCGAACAACTGGAAAAAATC<br>TCAGGGAATAAGATCACTGACGAGAGCTTGGAGAAGGC<br>TATTGAAATTTACGATGAGCACCGTAAAGTCATGAACG<br>ATTTCTCTATGCTTGCGTCCAAGTACCCTGGTATCATTA<br>CGCCAACGAAACGTAACTACGTGATGAAGTCAGCGTAT<br>TATATGGACAAGAAAGAACATACAGAGAAGGTACGTC<br>AGTTGATGGATGAAATCAAGGCCATTGAGCCTAAACCA<br>TTCGAAGGAAAACGCGTGATTACCACTGGGATCATTGC<br>AGATTCGGAGGACCTTTTGAAAATCTTGGAGGAGAATA<br>ACATTGCTATCGTGGGAGATGATATTGCACACGAGTCT<br>CGCCAATACCGCACTTTGACCCCGGAGGCCAACACACC<br>TATGGACCGTCTTGCTGAACAATTTGCGAACCGCGAGT<br>GTTCGACGTTGTATGACCCTGAAAAAAAACGTGGACAG<br>TATATTGTCGAGATGGCAAAAGAGCGTAAGGCCGACGG<br>AATCATCTTCTTCATGACAAAATTCTGCGATCCCGAAGA<br>ATACGATTACCCTCAGATGAAAAAAGACTTCGAAGAAG<br>CCGGTATTCCCCACGTTCTGATTGAGACAGACATGCAA<br>ATGAAGAACTACGAACAAGCTCGCACCGCTATTCAAGC<br>ATTTTCAGAAACCCTTTG |
| AcuI<br>SEQ ID NO: 280 | ATGCGTGCTGTCTTAATCGAGAAGTCAGATGACACCCA<br>GAGTGTTTCAGTTACGGAGTTGGCTGAAGACCAATTAC<br>CCGAAGGTGACGTCCTTGTGGATGTCGCGTACAGCACA<br>TTGAATTACAAGGATGCTCTTGCGATTACTGGAAAAGC<br>ACCCGTTGTACGCCGTTTTCCTATGGTCCCCGGAATTGA |

| Description | Sequence |
|---|---|
| | CTTTACTGGGACTGTCGCACAGAGTTCCCATGCTGATTT<br>CAAGCCAGGCGACCGCGTAATTCTGAACGGATGGGGAG<br>TTGGTGAGAAACACTGGGGCGGTCTTGCAGAACGCGCA<br>CGCGTACGTGGGGACTGGCTTGTCCCGTTGCCAGCCCCC<br>TTAGACTTGCGCCAGGCTGCAATGATTGGCACTGCGGG<br>GTACACAGCTATGCTGTGCGTGCTTGCCCTTGAGCGCCA<br>TGGAGTCGTACCTGGGAACGGCGAGATTGTCGTCTCAG<br>GCGCAGCAGGAGGGGTAGGTTCTGTAGCAACCACACTG<br>TTAGCAGCCAAAGGCTACGAAGTGGCCGCCGTGACCGG<br>GCGCGCAAGCGAGGCCGAATATTTACGCGGATTAGGCG<br>CCGCGTCGGTCATTGATCGCAATGAATTAACGGGGAAG<br>GTGCGTCCATTAGGGCAGGAACGCTGGGCAGGAGGAAT<br>CGATGTAGCAGGATCAACCGTACTTGCTAATATGTTGA<br>GCATGATGAAATACCGTGGCGTGGTGGCGGCCTGTGGC<br>CTGGCGGCTGGAATGGACTTGCCCGCGTCTGTCGCCCCT<br>TTTATTCTGCGTGGTATGACTTTGGCAGGGGTAGATTCA<br>GTCATGTGCCCCAAAACTGATCGTCTGGCTGCTTGGGCA<br>CGCCTGGCATCCGACCTGGACCCTGCAAAGCTGGAAGA<br>GATGACAACTGAATTACCGTTCTCTGAGGTGATTGAAA<br>CGGCTCCGAAGTTCTTGGATGGAACAGTGCGTGGGCGT<br>ATTGTCATTCCGGTAACACCTTGA |
| fldH1<br>SEQ ID NO: 281 | ATGAAAATCTTGGCATACTGCGTCCGCCCAGACGAGGT<br>AGACTCCTTTAAGAAATTTAGTGAAAAGTACGGGCATA<br>CAGTTGATCTTATTCCAGACTCTTTTGGACCTAATGTCG<br>CTCATTTGGCGAAGGGTTACGATGGGATTTCTATTCTGG<br>GCAACGACACGTGTAACCGTGAGGCACTGGAGAAGATC<br>AAGGATTGCGGGATCAAATATCTGGCAACCCGTACAGC<br>CGGAGTGAACAACATTGACTTCGATGCAGCAAAGGAGT<br>TCGGTATTAACGTGGCTAATGTTCCCGCATATTCCCCCA<br>ACTCGGTCAGCGAATTTACCATTGGATTGGCATTAAGTC<br>TGACGCGTAAGATTCCATTTGCCCTGAAACGCGTGGAA<br>CTGAACAATTTTGCGCTTGGCGGCCTTATTGGTGTGGAA<br>TTGCGTAACTTAACTTTAGGAGTCATCGGTACTGGTCGC<br>ATCGGATTGAAAGTGATTGAGGGCTTCTCTGGGTTTGG<br>AATGAAAAAAATGATCGGTTATGACATTTTTGAAAATG<br>AAGAAGCAAAGAAGTACATCGAATACAAATCATTAGAC<br>GAAGTTTTTAAAGAGGCTGATATTATCACTCTGCATGCG<br>CCTCTGACAGACGACAACTATCATATGATTGGTAAAGA<br>ATCCATTGCTAAAATGAAGGATGGGGTATTTATTATCA<br>ACGCAGCGCGTGGAGCCTTAATCGATAGTGAGGCCCTG<br>ATTGAAGGGTTAAAATCGGGGAAGATTGCGGGCGCGGC<br>TCTGGATAGCTATGAGTATGAGCAAGGTGTCTTTCACA<br>ACAATAAGATGAATGAAATTATGCAGGATGATACCTTG<br>GAACGTCTGAAATCTTTTCCCAACGTCGTGATCACGCCG<br>CATTTGGGTTTTTATACTGATGAGGCGGTTTCCAATATG<br>GTAGAGATCACACTGATGAACCTTCAGGAATTCGAGTT<br>GAAAGGAACCTGTAAGAACCAGCGTGTTTGTAAATGA |
| fbrAroG-TrpDH-<br>fldABCDH(RBS and<br>leader region<br>SEQ ID NO: 282 | <u>Ctctagaaataatttttgtttaactttaagaaggagatatacat</u><br>atgaattatcagaacgacgatttacgcatcaaagaaatcaaagagttacttcctcctgtcgcatt<br>gctggaaaaattccccgctactgaaaatgccgcgaatacggtcgcccatgcccgaaaagcg<br>atccataagatcctgaaaggtaatgatgatcgcctgttggtggtgattggcccatgctcaattc<br>atgatcctgtcgcggctaaagagtatgccactcgcttgctgacgctgcgtgaagagctgcaa<br>gatgagctggaaatcgtgatgcgcgtctattttgaaaagccgcgtactacggtgggctggaa<br>agggctgattaacgatccgcatatggataacagcttccagatcaacgacggtctgcgtattgc<br>ccgcaaattgctgctcgatattaacgacagcggtctgccagcggcgggtgaattcctggata<br>tgatcaccctacaatatctcgctgacctgatgagctggggcgcaattggcgcacgtaccacc<br>gaatcgcaggtgcaccgcgaactggcgtctggtctttcttgtccggtaggtttcaaaaatggc<br>actgatggtacgattaaagtggctatcgatgccattaatgccgccggtgcgccgcactgcttc<br>ctgtccgtaacgaaatgggggcattcggcgattgtgaataccagcggtaacggcgattgcc<br>atatcattctgcgcggcggtaaagagcctaactacagcgcgaagcacgttgctgaagtgaa<br>agaagggctgaacaaagcaggcctgccagcgcaggtgatgatcgatttcagccatgctaac<br>tcgtcaaaacaattcaaaaagcagatggatgtttgtactgacgtttgccagcagattgccggt<br>ggcgaaaaggccattattggcgtgatggtggaaagccatctggtggaaggcaatcagagc<br>ctcgagagcggggaaccgctggcctacggtaagagcatcaccgatgcctgcattggctgg<br>gatgataccgatgctctgttacgtcaactggcgagtgcagtaaaagcgcgtcgcgggtaaT<br>ACT<u>taagaaggagatatacat</u>ATGCTGTTATTCGAGACTGTGCGTG<br>AAATGGGTCATGAGCAAGTCCTTTTCTGTCATAGCAAG<br>AATCCCGAGATCAAGGCAATTATCGCAATCCACGATAC<br>CACCTTAGGACCGGCTGGGCGCAACTCGTATCTTACC<br>TTATATTAATGAGGAGGCTGCCCTGAAAGATGCATTAC<br>GTCTGTCCCGCGAATGACTTACAAAGCAGCCTGCGCC<br>AATATTCCCGCCGGGGCGGCAAAGCCGTCATCATCGC<br>TAACCCCGAAAACAAGACCGATGACCTGTTACGCGCAT<br>ACGGCCGTTTCGTGGACAGCTTGAACGGCCGTTTCATCA<br>CCGGGCAGGACGTTAACATTACGCCCGACGACGTTCGC |

| Description | Sequence |
|---|---|
| | ACTATTTCGCAGGAGACTAAGTACGTGGTAGGCGTCTC |
| | AGAAAAGTCGGGAGGGCCGGCACCTATCACCTCTCTGG |
| | GAGTATTTTTAGGCATCAAAGCCGCTGTAGAGTCGCGTT |
| | GGCAGTCTAAACGCCTGGATGGCATGAAAGTGGCGGTG |
| | CAAGGACTTGGGAACGTAGGAAAAAATCTTTGTCGCCA |
| | TCTGCATGAACACGATGTACAACTTTTTGTGTCTGATGT |
| | CGATCCAATCAAGGCCGAGGAAGTAAAACGCTTATTCG |
| | GGGCGACTGTTGTCGAACCGACTGAAATCTATTCTTTAG |
| | ATGTTGATATTTTTGCACCGTGTGCACTTGGGGGTATTT |
| | TGAATAGCCATACCATCCCGTTCTTACAAGCCTCAATCA |
| | TCGCAGGAGCAGCGAATAACCAGCTGGAGAACGAGCA |
| | ACTTCATTCGCAGATGCTTGCGAAAAAGGGTATTCTTTA |
| | CTCACCAGACTACGTTATCAATGCAGGAGGACTTATCA |
| | ATGTTTATAACGAAATGATCGGATATGACGAGGAAAAA |
| | GCATTCAAACAAGTTCATAACATCTACGATACGTTATTA |
| | GCGATTTTCGAAATTGCAAAAGAACAAGGTGTAACCAC |
| | CAACGACGCGGCCCGTCGTTTAGCAGAGGATCGTATCA |
| | ACAACTCCAAACGCTCAAGAGTAAAGCGATTGCGGCG |
| | TGAAATG<u>taagaaggagatatacat</u>ATGGAAAACAACACCAATAT |
| | GTTCTCTGGAGTGAAGGTGATCGAACTGGCCAACTTTAT |
| | CGCTGCTCCGGCGGCAGGTCGCTTCTTTGCTGATGGGGG |
| | AGCAGAAGTAATTAAGATCGAATCTCCAGCAGGCGACC |
| | CGCTGCGCTACACGGCCCCATCAGAAGGACGCCCGCTT |
| | TCTCAAGAGGAAAACACAACGTATGATTTGGAAAACGC |
| | GAATAAGAAAGCAATTGTTCTGAACTTAAAATCGGAAA |
| | AAGGAAAGAAATTCTTCACGAGATGCTTGCTGAGGCA |
| | GACATCTTGTTAACAAATTGGCGCACGAAAGCGTTAGT |
| | CAAACAGGGGTTAGATTACGAAACACTGAAAGAGAAG |
| | TATCCAAAATTGGTATTTGCACAGATTACAGGATACGG |
| | GGAGAAAGGACCCGACAAAGACCTGCCTGGTTTCGACT |
| | ACACGGCGTTTTTCGCCCGCGGAGGAGTCTCCGGTACA |
| | TTATATGAAAAAGGAACTGTCCCTCCTAATGTGGTACC |
| | GGGTCTGGGTGACCACCAGGCAGGAATGTTCTTAGCTG |
| | CCGGTATGGCTGGTGCGTTGTATAAGGCCAAAACCACC |
| | GGACAAGGCGACAAAGTCACCGTTAGTCTGATGCATAG |
| | CGCAATGTACGGCCTGGGAATCATGATTCAGGCAGCCC |
| | AGTACAAGGACCATGGGCTGGTGTACCCGATCAACCGT |
| | AATGAAACGCCTAATCCTTTCATCGTTTCATACAAGTCC |
| | AAAGATGATTACTTTGTCCAAGTTTGCATGCCTCCCTAT |
| | GATGTGTTTTATGATCGCTTTATGACGGCCTTAGGACGT |
| | GAAGACTTGGTAGGTGACGAACGCTACAATAAGATCGA |
| | GAACTTGAAGGATGGTCGCGCAAAAGAAGTCTATTCCA |
| | TCATCGAACAACAAATGGTAACGAAGACGAAGGACGA |
| | ATGGGACAAGATTTTTCGTGATGCAGACATTCCATTCGC |
| | TATTGCCCAAACGTGGGAAGATCTTTTAGAAGACGAGC |
| | AGGCATGGGCCAACGACTACCTGTATAAAATGAAGTAT |
| | CCCACAGGCAACGAACGTGCCCTGGTACGTTTACCTGT |
| | GTTCTTCAAAGAAGCTGGACTTCCTGAATACAACCAGT |
| | CGCCACAGATTGCTGAGAATACCGTGGAAGTGTTAAAG |
| | GAGATGGGATATACCGAGCAAGAAATTGAGGAGCTTGA |
| | GAAAGACAAAGACATCATGGTACGTAAAGAGAAATGA |
| | AGGT<u>taagaaggagatatacat</u>ATGTCAGACCGCAACAAAGAAGT |
| | GAAAGAAAAGAAGGCTAAACACTATCTGCGCGAGATC |
| | ACAGCTAAACACTACAAGGAAGCGTTAGAGGCTAAAG |
| | AGCGTGGGGAGAAAGTGGGTTGGTGTGCCTCTAACTTC |
| | CCCCAAGAGATTGCAACCACGTTGGGTGTAAAGGTTGT |
| | TTATCCCGAAAACCACGCCGCCGCCGTAGCGGCACGTG |
| | GCAATGGGCAAAATATGTGCGAACACGCGGAGGCTATG |
| | GGATTCAGTAATGATGTGTGTGGATATGCACGTGTAAA |
| | TTTAGCCGTAATGGACATCGGCCATAGTGAAGATCAAC |
| | CTATTCCAATGCCTGATTTCGTTCTGTGCTGTAATAATA |
| | TCTGCAATCAGATGATTAAATGGTATGAACACATTGCA |
| | AAAACGTTGGATATTCCTATGATCCTTATCGATATTCCA |
| | TATAATACTGAGAACACGGTGTCTCAGGACCGCATTAA |
| | GTACATCCGCGCCCAGTTCGATGACGCTATCAAGCAAC |
| | TGGAAGAAATCACTGGCAAAAAGTGGGACGAGAATAA |
| | ATTCGAAGAAGTGATGAAGATTTCGCAAGAATCGGCCA |
| | AGCAATGGTTACGCGCCGCGAGCTACGCGAAATACAAA |
| | CCATCACCGTTTTCGGGCTTTGACCTTTTTAATCACATG |
| | GCTGTAGCCGTTTGTGCTCGCGGCACCCAGGAAGCCGC |
| | CGATGCATTCAAAATGTTAGCAGATGAATATGAAGAGA |
| | ACGTTAAGACAGGAAAGTCTACTTATCGCGGCGAGGAG |
| | AAGCAGCGTATCTTGTTCGAGGGCATCGCTTGTTGGCCT |
| | TATCTGCGCCACAAGTTGACGAAACTGAGTGAATATGG |
| | AATGAACGTCACAGCTACGGTGTACGCCGAAGCTTTTG |
| | GGGTTATTTACGAAAACATGGATGAACTGATGGCCGCT |
| | TACAATAAAGTGCCTAACTCAATCTCCTTCGAGAACGC |

| Description | Sequence |
|---|---|
| | GCTGAAGATGCGTCTTAATGCCGTTACAAGCACCAATA |
| | CAGAAGGGGCTGTTATCCACATTAATCGCAGTTGTAAG |
| | CTGTGGTCAGGATTCTTATACGAACTGGCCCGTCGTTTG |
| | GAAAAGGAGACGGGGATCCCTGTTGTTTCGTTCGACGG |
| | AGATCAAGCGGATCCCCGTAACTTCTCCGAGGCTCAAT |
| | ATGACACTCGCATCCAAGGTTTAAATGAGGTGATGGTC |
| | GCGAAAAAAGAAGCAGAGTGAGCTTtaagaaggagatatacatAT |
| | GTCGAATAGTGACAAGTTTTTTAACGACTTCAAGGACA |
| | TTGTGGAAAACCCAAAGAAGTATATCATGAAGCATATG |
| | GAACAAACGGGACAAAAAGCCATCGGTTGCATGCCTTT |
| | ATACACCCCAGAAGAGCTTGTCTTAGCGGCGGGTATGT |
| | TTCCTGTTGGAGTATGGGGCTCGAATACTGAGTTGTCAA |
| | AAGCCAAGACCTACTTTCCGGCTTTTATCTGTTCTATCT |
| | TGCAAACTACTTTAGAAAACGCATTGAATGGGGAGTAT |
| | GACATGCTGTCTGGTATGATGATCACAAACTATTGCGAT |
| | TCGCTGAAATGTATGGGACAAAACTTCAAACTTACAGT |
| | GGAAAATATCGAATTCATCCCGGTTACGGTTCCACAAA |
| | ACCGCAAGATGGAGGCGGGTAAAGAATTTCTGAAATCC |
| | CAGTATAAAATGAATATCGAACAACTGGAAAAAATCTC |
| | AGGGAATAAGATCACTGACGAGAGCTTGGAGAAGGCT |
| | ATTGAAATTTACGATGAGCACCGTAAAGTCATGAACGA |
| | TTTCTCTATGCTTGCGTCCAAGTACCCTGGTATCATTAC |
| | GCCAACGAAACGTAACTACGTGATGAAGTCAGCGTATT |
| | ATATGGACAAGAAAGAACATACAGAGAAGGTACGTCA |
| | GTTGATGGATGAAATCAAGGCCATTGAGCCTAAACCAT |
| | TCGAAGGAAAACGCGTGATTACCACTGGGATCATTGCA |
| | GATTCGGAGGACCTTTTGAAAATCTTGGAGGAGAATAA |
| | CATTGCTATCGTGGGAGATGATATTGCACACGAGTCTC |
| | GCCAATACCGCACTTTGACCCCGGAGGCCAACACACCT |
| | ATGGACCGTCTTGCTGAACAATTTGCGAACCGCGAGTG |
| | TTCGACGTTGTATGACCCTGAAAAAAACGTGGACAGT |
| | ATATTGTCGAGATGGCAAAAGAGCGTAAGGCCGACGGA |
| | ATCATCTTCTTCATGACAAAATTCTGCGATCCCGAAGAA |
| | TACGATTACCCTCAGATGAAAAAAGACTTCGAAGAAGC |
| | CGGTATTCCCCACGTTCTGATTGAGACAGACATGCAAA |
| | TGAAGAACTACGAACAAGCTCGCACCGCTATTCAAGCA |
| | TTTTCAGAAACCCTTTGACGCTtaagaaggagatatacatATGTTC |
| | TTTACGGAGCAACACGAACTTATTCGCAAACTGGCGCG |
| | TGACTTTGCCGAACAGGAAATCGAGCCTATCGCAGACG |
| | AAGTAGATAAAACCGCAGAGTTCCCAAAAGAAATCGTG |
| | AAGAAGATGGCTCAAAATGGATTTTTCGGCATTAAAAT |
| | GCCTAAAGAATACGGAGGGGCGGGTGCGGATAACCGC |
| | GCTTATGTCACTATTATGGAGGAAATTTCACGTGCTTCC |
| | GGGGTAGCGGGTATCTACCTGAGCTCGCCGAACAGTTT |
| | GTTAGGAACTCCCTTCTTATTGGTCGGAACCGATGAGCA |
| | AAAAGAAAAGTACCTTAAGCCTATGATCCGCGGCGAGA |
| | AGACTCTGGCGTTCGCCCTGACAGAGCCTGGTGCTGGC |
| | TCTGATGCGGGTGCGTTGGCTACTACTGCCCGTGAAGA |
| | GGGCGACTATTATATCTTAAATGGCCGCAAGACGTTTAT |
| | TACAGGGGCTCCTATTAGCGACAATATTATTGTGTTCGC |
| | AAAAACCGATATGAGCAAAGGGACCAAAGGTATCACC |
| | ACTTTCATTGTGGACTCAAAGCAGGAAGGGGTAAGTTT |
| | TGGTAAGCCAGAGGACAAAATGGGAATGATTGGTTGTC |
| | CGACAAGCGACATCATCTTGGAAAACGTTAAAGTTCAT |
| | AAGTCCGACATCTTGGGAGAAGTCAATAAGGGGTTTAT |
| | TACCGCGATGAAAACACTTTCCGTTGGTCGTATCGGAGT |
| | GGCGTCACAGGCGCTTGGAATTGCACAGGCCGCCGTAG |
| | ATGAGGCGGTAAAGTACGCCAAGCAACGTAAACAATTC |
| | AATCGCCCAATCGCGAAATTTCAGGCCATTCAATTTAA |
| | ACTTGCCAATATGGAGACTAAATTAAATGCCGCTAAAC |
| | TTCTTGTTTATAACGCAGCGTACAAAATGGATTGTGGAG |
| | AAAAAGCCGACAAGGAAGCCTCTATGGCTAAATACTTT |
| | GCTGCTGAATCAGCGATCCAAATCGTTAACGACGCGCT |
| | GCAAATCCATGGCGGGTATGGCTATATCAAAGACTACA |
| | AGATTGAACGTTTGTACCGCGATGTGCGTGTGATCGCTA |
| | TTTATGAGGGCACTTCCGAGGTCCAACAGATGGTTATC |
| | GCGTCCAATCTGCTGAAGTAATACTtaagaaggagatatacatAT |
| | GAAAATCTTGGCATACTGCGTCCGCCCAGACGAGGTAG |
| | ACTCCTTTAAGAAATTTAGTGAAAAGTACGGGCATACA |
| | GTTGATCTTATTCCAGACTCTTTTGGACCTAATGTCGCT |
| | CATTTGGCGAAGGGTTACGATGGGATTTCTATTCTGGGC |
| | AACGACACGTGTAACCGTGAGGCACTGGAGAAGATCAA |
| | GGATTGCGGGATCAAATATCTGGCAACCCGTACAGCCG |
| | GAGTGAACAACATTGACTTCGATGCAGCAAGGGAGTTC |
| | GGTATTAACGTGGCTAATGTTCCCGCATATTCCCCCAAC |
| | TCGGTCAGCGAATTTACCATTGGATTGGCATTAAGTCTG |
| | ACGCGTAAGATTCCATTTGCCCTGAAACGCGTGGAACT |

| Description | Sequence |
|---|---|
| | GAACAATTTTGCGCTTGGCGGCCTTATTGGTGTGGAATT<br>GCGTAACTTAACTTTAGGAGTCATCGGTACTGGTCGCAT<br>CGGATTGAAAGTGATTGAGGGCTTCTCTGGGTTTGGAA<br>TGAAAAAAATGATCGGTTATGACATTTTTGAAAATGAA<br>GAAGCAAAGAAGTACATCGAATACAAATCATTAGACGA<br>AGTTTTTAAAGAGGCTGATATTATCACTCTGCATGCGCC<br>TCTGACAGACGACAACTATCATATGATTGGTAAAGAAT<br>CCATTGCTAAAATGAAGGATGGGGTATTTATTATCAAC<br>GCAGCGCGTGGAGCCTTAATCGATAGTGAGGCCCTGAT<br>TGAAGGGTTAAAATCGGGGAAGATTGCGGGCGCGGCTC<br>TGGATAGCTATGAGTATGAGCAAGGTGTCTTTCACAAC<br>AATAAGATGAATGAAATTATGCAGGATGATACCTTGGA<br>ACGTCTGAAATCTTTTCCCAACGTCGTGATCACGCCGCA<br>TTTGGGTTTTTATACTGATGAGGCGGTTTCCAATATGGT<br>AGAGATCACACTGATGAACCTTCAGGAATTCGAGTTGA<br>AAGGAACCTGTAAGAACCAGCGTGTTTGTAAATGA |
| FldD<br>SEQ ID NO: 283 | ATGTTCTTTACGGAGCAACACGAACTTATTCGCAAACTG<br>GCGCGTGACTTTGCCGAACAGGAAATCGAGCCTATCGC<br>AGACGAAGTAGATAAAACCGCAGAGTTCCCAAAAGAA<br>ATCGTGAAGAAGATGGCTCAAAATGGATTTTTCGGCAT<br>TAAAATGCCTAAAGAATACGGAGGGGCGGGTGCGGAT<br>AACCGCGCTTATGTCACTATTATGGAGGAAATTTCACGT<br>GCTTCCGGGGTAGCGGGTATCTACCTGAGCTCGCCGAA<br>CAGTTTGTTAGGAACTCCCTTCTTATTGGTCGGAACCGA<br>TGAGCAAAAGAAAAGTACCTTAAGCCTATGATCCGCG<br>GCGAGAAGACTCTGGCGTTCGCCCTGACAGAGCCTGGT<br>GCTGGCTCTGATGCGGGTGCGTTGGCTACTACTGCCCGT<br>GAAGAGGGCGACTATTATATCTTAAATGGCCGCAAGAC<br>GTTTATTACAGGGGCTCCTATTAGCGACAATATTATTGT<br>GTTCGCAAAAACCGATATGAGCAAAGGGACCAAAGGT<br>ATCACCACTTTCATTGTGGACTCAAAGCAGGAAGGGGT<br>AAGTTTTGGTAAGCCAGAGGACAAAATGGGAATGATTG<br>GTTGTCCGACAAGCGACATCATCTTGGAAAACGTTAAA<br>GTTCATAAGTCCGACATCTTGGGAGAAGTCAATAAGGG<br>GTTTATTACCGCGATGAAAACACTTTCCGTTGGTCGTAT<br>CGGAGTGGCGTCACAGGCGCTTGGAATTGCACAGGCCG<br>CCGTAGATGAGGCGGTAAAGTACGCCAAGCAACGTAAA<br>CAATTCAATCGCCCAATCGCGAAATTTCAGGCCATTCA<br>ATTTAAACTTGCCAATATGGAGACTAAATTAAATGCCG<br>CTAAACTTCTTGTTTATAACGCAGCGTACAAAATGGATT<br>GTGGAGAAAAAGCCGACAAGGAAGCCTCTATGGCTAA<br>ATACTTTGCTGCTGAATCAGCGATCCAAATCGTTAACGA<br>CGCGCTGCAAATCCATGGCGGGTATGGCTATATCAAAG<br>ACTACAAGATTGAACGTTTGTACCGCGATGTGCGTGTG<br>ATCGCTATTTATGAGGGCACTTCCGAGGTCCAACAGAT<br>GGTTATCGCGTCCAATCTGCTGAAGTAA |

SEQUENCE LISTING (293 sequences)

SEQ ID NO: 1 - DNA, 1137 bp, Artificial Sequence
  Description of Artificial Sequence: Synthetic polynucleotide
atggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatag

SEQ ID NO: 2 - DNA, 783 bp, Artificial Sequence
  Description of Artificial Sequence: Synthetic polynucleotide
atgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataa

SEQ ID NO: 3 - DNA, 1011 bp, Artificial Sequence
  Description of Artificial Sequence: Synthetic polynucleotide
atgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaa

SEQ ID NO: 4 - DNA, 1176 bp, Artificial Sequence
  Description of Artificial Sequence: Synthetic polynucleotide
atgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatag

SEQ ID NO: 5 - DNA, 846 bp, Artificial Sequence
  Description of Artificial Sequence: Synthetic polynucleotide
atgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataa

SEQ ID NO: 6 - DNA, 798 bp, Artificial Sequence
  Description of Artificial Sequence: Synthetic polynucleotide
atgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaa

SEQ ID NO: 7 - DNA, 903 bp, Artificial Sequence
  Description of Artificial Sequence: Synthetic polynucleotide
atgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataa

SEQ ID NO: 8 - DNA, 1080 bp, Artificial Sequence
  Description of Artificial Sequence: Synthetic polynucleotide
atgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaa

SEQ ID NO: 9 - DNA, 1194 bp, Artificial Sequence
  Description of Artificial Sequence: Synthetic polynucleotide
atgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctga

SEQ ID NO: 10 - DNA, 861 bp, Artificial Sequence
  Description of Artificial Sequence: Synthetic polynucleotide
atgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 11 - protein, 378 aa, Artificial Sequence
  Description of Artificial Sequence: Synthetic polypeptide
MDLNSKKYQMLKELYVSFAENEVKPLATELDEEERFPYETVEKMAKAGMMGIPYPKEYGGEGGDTVGYIMAVEELSRVCGTTGVILSAHTSLGSWPIYQYGNEEQKQKFLRPLASGEKLGAFGLTEPNAGTDASGQQTTAVLDGDEYILNGSKIFITNAIAGDIYVVMAMTDKSKGNKGISAFIVEKGTPGFSFGVKEKKMGIRGSATSELIFEDCRIPKENLLGKEGQGFKIAMSTLDGGRIGIAAQALGLAQGALDETVKYVKERVQFGRPLSKFQNTQFQLADMEVKVQAARHLVYQAAINKDLGKPYGVEAAMAKLFAAETAMEVTTKAVQLHGGYGYTRDYPVERMMRDAKITEIYEGTSEVQRMVISGKLLK

SEQ ID NO: 12 - protein, 260 aa, Artificial Sequence
  Description of Artificial Sequence: Synthetic polypeptide
MNIVVCIKQVPDTTEVKLDPNTGTLIRDGVPSIINPDDKAGLEEAIKLKEEMGAHVTVITMGPPQADMALKEALAMGADRGILLTDRAFAGADTWATSSALAGALKNIDFDIIIAGRQAIDGDTAQVGPQIAEHLNLPSITYAEEIKTEGEYVLVKRQFEDCCHDLKVKMPCLITTLKDMNTPRYMKVGRIYDAFENDVVETWTVKDIEVDPSNLGLKGSPTSVFKSFTKSVKPAGTIYNEDAKTSAGIIIDKLKEKYII

SEQ ID NO: 13 - protein, 336 aa, Artificial Sequence
  Description of Artificial Sequence: Synthetic polypeptide
MGNVLVVIEQRENVIQTVSLELLGKATEIAKDYDTKVSALLLGSKVEGLIDTLAHYGADEVIVVDDEALAVYTTEPYTKAAYEAIKAADPIVVLFGATSIGRDLAPRVSARIHTGLTADCTGLAVAEDTKLLLMTRPAFGGNIMATIVCKDFRPQMSTVRPGVMKKNEPDETKEAVINRFKVEFNDADKLVQVVQVIKEAKKQVKIEDAKILVSAGRGMGGKENLDILYELAEIIGGEVSGSRATIDAGWLDKARQVGQTGKTVRPDLYIACGISGAIQHIAGMEDAEFIVAINKNPEAPIFKYADVGIVGDVHKVLPELISQLSVAKEKGEVLAN

SEQ ID NO: 14 - protein, 397 aa, Artificial Sequence
  Description of Artificial Sequence: Synthetic polypeptide
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRI

SEQ ID NO: 15 - protein, 391 aa, Artificial Sequence
  Description of Artificial Sequence: Synthetic polypeptide
MREVVIASAARTAVGSFGGAFKSVSAVELGVTAAKEAIKRANITPDMIDESLLGGVLTAGLGQNIARQIALGAGIPVEKPAMTINIVCGSGLRSVSMASQLIALGDADIMLVGGAENMSMSPYLVPSARYGARMGDAAFVDSMIKDGLSDIFNNYHMGITAENIAEQWNITREEQDELALASQNKAEKAQAEGKFDEEIVPVVIKGRKGDTVVDKDEYIKPGTTMEKLAKLRPAFKKDGTVTAGNASGINDGAAMLVVMAKEKAEELGIEPLATIVSYGTAGVDPKIMGYGPVPATKKALEAANMTIEDIDLVEANEAFAAQSVAVIRDLNIDMNKVNVNGGAIAIGHPIGCSGARILTTLLYEMKRRDAKTGLATLCIGGGMGTTLIVKR

SEQ ID NO: 16 - protein, 281 aa, Artificial Sequence
  Description of Artificial Sequence: Synthetic polypeptide
MKLAVIGSGTMGSGIVQTFASCGHDVCLKSRTQGAIDKCLALLDKNLTKLVTKGKMDEATKAEILSHVSSTTNYEDLKDMDLIIEASVEDMNIKKDVFKLLDELCKEDTILATNTSSLSITEIASSTKRPDKVIGMHFFNPVPMMKLVEVISGQLTSKVTFDTVFELSKSINKVPVDVSESPGFVVNRILIPMINEAVGIYADGVASKEEIDEAMKLGANHPMGPLALGDLIGLDVVLAIMNVLYTEFGDTKYRPHPLLAKMVRANQLGRKTKIGFYDYNK

SEQ ID NO: 17 - protein, 265 aa, Artificial Sequence
  Description of Artificial Sequence: Synthetic polypeptide
MSTSDVKVYENVAVEVDGNICTVKMNRPKALNAINSKTLEELYEVFVDINNDETIDVVILTGEGKAFVAGADIAYMKDLDAVAAKDFSILGAKAFGEIENSKKVVIAAVNGFALGGGCELAMACDIRIASAKAKFGQPEVTLGITPGYGGTQRLTRLVGMAKAKELIFTGQVIKADEAEKIGLVNRVVEPDILIEEVEKLAKIIAKNAQLAVRYSKEAIQLGAQTDINTGIDIESNLFGLCFSTKDQKEGMSAFVEKREANFIKG

SEQ ID NO: 18 - protein, 300 aa, Artificial Sequence
  Description of Artificial Sequence: Synthetic polypeptide
MRSFEEVIKFAKERGPKTISVACCQDKEVLMAVEMARKEKIANAILVGDIEKTKEIAKSIDMDIENYELIDIKDLAEASLKSVELVSQGKADMVMKGLVDTSIILKAVLNKEVGLRTGNVLSHVAVFDVEGYDRLFFVTDAAMNLAPDTNTKKQIIENACTVAHSLDISEPKVAAICAKEKVNPKMKDTVEAKELEEMYERGEIKGCMVGGPFAIDNAVSLEAAKHKGINHPVAGRADILLAPDIEGGNILYKALVFFSKSKNAGVIVGAKAPIILTSRADSEETKLNSIALGVLMAAKA

SEQ ID NO: 19 - protein, 359 aa, Artificial Sequence
  Description of Artificial Sequence: Synthetic polypeptide
MSKIFKILTINPGSTSTKIAVFDNEDLVFEKTLRHSSEEIGKYEKVSDQFEFRKQVIEEALKEGGVKTSELDAVVGRGGLLKPIKGGTYSVSAAMIEDLKVGVLGEHASNLGGIIAKQIGEEVNVPSYIVDPVVVDELEDVARISGMPEISRASVVHALNQKAIARRYAREINKKYEDINLIVAHMGGGVSVGAHKNGKIVDVANALDGEGPFSPERSGGLPVGALVKMCFSGKYTQDEIKKKIKGNGGLVAYLNTNDAREVEERIEAGDEKAKLVYEAMAYQISKEIGASAAVLKGDVKAILLTGGIAYSKMFTEMIADRVKFIADVKVYPGEDEMIALAQGGLRVLTGEEEAQVYDN

SEQ ID NO: 20 - protein, 286 aa, Artificial Sequence
  Description of Artificial Sequence: Synthetic polypeptide
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 21 - DNA, 1575 bp, Artificial Sequence
  Description of Artificial Sequence: Synthetic polynucleotide
atgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttaa

SEQ ID NO: 22 - DNA, 1269 bp, Artificial Sequence
  Description of Artificial Sequence: Synthetic polynucleotide
atgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataa

SEQ ID NO: 23 - DNA, 1125 bp, Artificial Sequence
  Description of Artificial Sequence: Synthetic polynucleotide
atgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcagatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaa

SEQ ID NO: 24 - DNA, 779 bp, Artificial Sequence
  Description of Artificial Sequence: Synthetic polynucleotide
atgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagta

SEQ ID NO: 25 - DNA, 1104 bp, Artificial Sequence
  Description of Artificial Sequence: Synthetic polynucleotide
atggccttcaatagcgcagatattaattctttccgcgatatttgggtgttttgtgaacagcgtgagggcaaactgattaacaccgatttcgaattaattagcgaaggtcgtaaactggctgacgaacgcggaagcaaactggttggaattttgctggggcacgaagttgaagaaatcgcaaaagaattaggcggctatggtgcggacaaggtaattgtgtgcgatcatccggaacttaaattttacactacggatgcttatgccaaagttttatgtgacgtcgtgatggaagagaaaccggaggtaattttgatcggtgccaccaacattggccgtgatctcggaccgcgttgtgctgcacgcttgcacacggggctgacggctgattgcacgcacctggatattgatatgaataaatatgtggactttcttagcaccagtagcaccttggatatctcgtcgatgactttccctatggaagatacaaaccttaaaatgacgcgccctgcatttggcggacatctgatggcaacgatcatttgtccacgcttccgtccctgtatgagcacagtgcgccccggagtgatgaagaaagcggagttctcgcaggagatggcgcaagcatgtcaagtagtgacccgtcacgtaaatttgtcggatgaagaccttaaaactaaagtaattaatatcgtgaaggaaacgaaaaagattgtggatctgatcggcgcagaaattattgtgtcagttggtcgtggtatctcgaaagatgtccaaggtggaattgcactggctgaaaaacttgcggacgcatttggtaacggtgtcgtgggcggctcgcgcgcagtgattgattccggctggttacctgcggatcatcaggttggacaaaccggtaagaccgtgcacccgaaagtctacgtggcgctgggtattagtggggctatccagcataaggctgggatgcaagactctgaactgatcattgccgtcaacaaagacgaaacggcgcctatcttcgactgcgccgattatggcatcaccggtgatttatttaaaatcgtaccgatgatgatcgacgcgatcaaagagggtaaaaacgcatga

SEQ ID NO: 26 - DNA, 804 bp, Artificial Sequence
  Description of Artificial Sequence: Synthetic polynucleotide
atgcgcatctatgtgtgtgtgaaacaagtcccagatacgagcggcaaggtggccgttaaccctgatgggacccttaaccgtgcctcaatggcagcgattattaacccggacgatatgtccgcgatcgaacaggcattaaaactgaaagatgaaaccggatgccaggttacggcgcttacgatgggtcctcctcctgccgagggcatgttgcgcgaaattattgcaatgggggccgacgatggtgtgctgatttcggcccgtgaatttggggggtccgataccttcgcaaccagtcaaattattagcgcggcaatccataaattaggcttaagcaatgaagacatgatcttttgcggtcgtcaggccattgacggtgatacggcccaagtcggccctcaaattgccgaaaaactgagcatcccacaggtaacctatggcgcaggaatcaaaaaatctggtgatttagtgctggtgaagcgtatgttggaggatggttatatgatgatcgaagtcgaaactccatgtctgattacctgcattcaggataaagcggtaaaaccacgttacatgactctcaacggtattatggaatgctactccaagccgctcctcgttctcgattacgaagcactgaaagatgaaccgctgatcgaacttgataccattgggcttaaaggctccccgacgaatatctttaaatcgtttacgccgcctcagaaaggcgttggtgtcatgctccaaggcaccgataaggaaaaagtcgaggatctggtggataagctgatgcagaaacatgtcatctaa

SEQ ID NO: 27 - DNA, 1185 bp, Artificial Sequence
  Description of Artificial Sequence: Synthetic polynucleotide
atgttcttactgaagattaaaaaagaacgtatgaaacgcatggactttagtttaacgcgtgaacaggagatgttaaaaaaactggcgcgtcagtttgctgagatcgagctggaaccggtggccgaagagattgatcgtgagcacgtttttcctgcagaaaactttaagaagatggcggaaattggcttaaccggcattggtatcccgaaagaatttggtggctccggtggaggcaccctggagaaggtcattgccgtgtcagaattcggcaaaaagtgtatggcctcagcttccattttaagcattcatcttatcgcgccgcaggcaatctacaaatatgggaccaaagaacagaaagagacgtacctgccgcgtcttaccaaaggtggtgaactgggcgcctttgcgctgacagaaccaaacgccggaagcgatgccggcgcggtaaaaacgaccgcgattctggacagccagacaaacgagtacgtgctgaatggcaccaaatgctttatcagcgggggcgggcgcgcgggtgttcttgtaatttttgcgcttactgaaccgaaaaaaggtctgaaagggatgagcgcgattatcgtggagaaagggaccccgggcttcagcatcggcaaggtggagagcaagatggggatcgcaggttcggaaaccgcggaacttatcttcgaagattgtcgcgttccggctgccaaccttttaggtaaagaaggcaaaggctttaaaattgctatggaagccctggatggcgcccgtattggcgtgggcgctcaagcaatcggaattgccgagggggcgatcgacctgagtgtgaagtacgttcacgagcgcattcaatttggtaaaccgatcgcgaatctgcagggaattcaatggtatatcgcggatatggcgaccaaaaccgccgcggcacgcgcacttgttgagtttgcagcgtatcttgaagacgcgggtaaaccgttcacaaaggaatctgctatgtgcaagctgaacgcctccgaaaacgcgcgttttgtgacaaatttagctctgcagattcacgggggttacggttatatgaaagattatccgttagagcgtatgtatcgcgatgctaagattacggaaatttacgaggggacatcagaaatccataaggtggtgattgcgcgtgaagtaatgaaacgctaa

SEQ ID NO: 28 - DNA, 2463 bp, Artificial Sequence
  Description of Artificial Sequence: Synthetic polynucleotide
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagagatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 29 - DNA, 933 bp, Artificial Sequence
  Description of Artificial Sequence: Synthetic polynucleotide
atggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaa

SEQ ID NO: 30 - DNA, 1287 bp, Artificial Sequence
  Description of Artificial Sequence: Synthetic polynucleotide
atgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaa

SEQ ID NO: 31 - DNA, 1311 bp, Artificial Sequence
  Description of Artificial Sequence: Synthetic polynucleotide
atgagtgaaacatacgtgtctgagaaaagtccaggagtgatggctagcggagcggagctgattcgtgccgccgacattcaaacggcgcaggcacgaatttcctccgtcattgcaccaactccattgcagtattgccctcgtctttctgaggaaaccggagcggaaatctaccttaagcgtgaggatctgcaggatgttcgttcctacaagatccgcggtgcgctgaactctggagcgcagctcacccaagagcagcgcgatgcaggtatcgttgccgcatctgcaggtaaccatgcccagggcgtggcctatgtgtgcaagtccttgggcgttcagggacgcatctatgttcctgtgcagactccaaagcaaaagcgtgaccgcatcatggttcacggcggagagtttgtctccttggtggtcactggcaataacttcgacgaagcatcggctgcagcgcatgaagatgcagagcgcaccggcgcaacgctgatcgagcctttcgatgctcgcaacaccgtcatcggtcagggcaccgtggctgctgagatcttgtcgcagctgacttccatgggcaagagtgcagatcacgtgatggttccagtcggcggtggcggacttcttgcaggtgtggtcagctacatggctgatatggcacctcgcactgcgatcgttggtatcgaaccagcgggagcagcatccatgcaggctgcattgcacaatggtggaccaatcactttggagactgttgatccctttgtggacggcgcagcagtcaaacgtgtcggagatctcaactacaccatcgtggagaagaaccagggtcgcgtgcacatgatgagcgcgaccgagggcgctgtgtgtactgagatgctcgatctttaccaaaacgaaggcatcatcgcggagcctgctggcgcgctgtctatcgctgggttgaaggaaatgtcctttgcacctggttctgcagtggtgtgcatcatctctggtggcaacaacgatgtgctgcgttatgcggaaatcgctgagcgctccttggtgcaccgcggtttgaagcactacttcttggtgaacttcccgcaaaagcctggtcagttgcgtcacttcctggaagatatcctgggaccggatgatgacatcacgctgtttgagtacctcaagcgcaacaaccgtgagaccggtactgcgttggtgggtattcacttgagtgaagcatcaggattggattctttgctggaacgtatggaggaatcggcaattgattcccgtcgcctcgagccgggcacccctgagtacgaatacttgacctaa

SEQ ID NO: 32 - DNA, 2664 bp, Artificial Sequence
  Description of Artificial Sequence: Synthetic polynucleotide
atgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaa

SEQ ID NO: 33 - DNA, 1893 bp, Artificial Sequence
  Description of Artificial Sequence: Synthetic polynucleotide
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaa

SEQ ID NO: 34 - DNA, 1425 bp, Artificial Sequence
  Description of Artificial Sequence: Synthetic polynucleotide
atgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccaaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaa

SEQ ID NO: 35 - DNA, 981 bp, Artificial Sequence
  Description of Artificial Sequence: Synthetic polynucleotide
atgcgtgcggtactgatcgagaagtccgatgatacacagtccgtctctgtcaccgaactggctgaagatcaactgccggaaggcgacgttttggtagatgttgcttattcaacactgaactacaaagacgccctggcaattaccggtaaagcccccgtcgttcgtcgttttccgatggtacctggaatcgactttacgggtaccgtggcccagtcttcccacgccgacttcaagccaggtgatcgcgtaatcctgaatggttggggtgtgggggaaaaacattggggcggtttagcggagcgcgctcgcgtgcgcggagactggcttgttcccttgccagcccccctggacttacgccaagcggccatgatcggtacagcaggatacacggcgatgttgtgcgttctggcgcttgaacgtcacggagtggtgccgggtaatggggaaatcgtggtgtccggtgcagcaggcggcgtcggctccgttgcgacgacccttcttgccgctaagggctatgaggtagcggcagtgactggacgtgcgtccgaagcagaatatctgcgcggtttgggggcggcgagcgtaattgatcgtaacgaattaacggggaaggtacgcccgctgggtcaggagcgttgggctggcgggattgacgtggcgggatcaaccgtgcttgcgaacatgctttctatgatgaagtatcgcggggtagtcgctgcgtgtggcctggccgcgggcatggatctgcccgcgtctgtcgcgccctttattcttcgtgggatgacgctggcaggggtggatagcgttatgtgcccaaagacagatcgtttagcagcgtgggcccgtttggcgtcagatcttgaccctgccaagctggaggagatgactacagagttgccgtttagtgaagtaatcgagacagcacccaaattcttggacgggacggttcgtggccgcattgttatccccgtaacgccctaa

SEQ ID NO: 36 - DNA, 2145 bp, Artificial Sequence
  Description of Artificial Sequence: Synthetic polynucleotide
atgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaa

SEQ ID NO: 37 - DNA, 996 bp, Artificial Sequence
  Description of Artificial Sequence: Synthetic polynucleotide
atgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaa

SEQ ID NO: 38 - DNA, 786 bp, Artificial Sequence
  Description of Artificial Sequence: Synthetic polynucleotide
atgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaa

SEQ ID NO: 39 - DNA, 1479 bp, Artificial Sequence
  Description of Artificial Sequence: Synthetic polynucleotide
atggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 40 - DNA, 1917 bp, Artificial Sequence
  Description of Artificial Sequence: Synthetic polynucleotide
atgagcagcacggatcaggggaccaaccccgccgacactgacgacctcactcccaccacactcagtctggccggggatttccccaaggccactgaggagcagtgggagcgcgaagttgagaaggtattcaaccgtggtcgtccaccggagaagcagctgaccttcgccgagtgtctgaagcgcctgacggttcacaccgtcgatggcatcgacatcgtgccgatgtaccgtccgaaggacgcgccgaagaagctgggttaccccggcgtcacccccttcacccgcggcaccacggtgcgcaacggtgacatggatgcctgggacgtgcgcgccctgcacgaggatcccgacgagaagttcacccgcaaggcgatccttgaagacctggagcgtggcgtcacctccctgttgttgcgcgttgatcccgacgcgatcgcacccgagcacctcgacgaggtcctctccgacgtcctgctggaaatgaccaaggtggaggtcttcagccgctacgaccagggtgccgccgccgaggccttgatgggcgtctacgagcgctccgacaagccggcgaaggacctggccctgaacctgggcctggatcccatcggcttcgcggccctgcagggcaccgagccggatctgaccgtgctcggtgactgggtgcgccgcctggcgaagttctcaccggactcgcgcgccgtcacgatcgacgcgaacgtctaccacaacgccggtgccggcgacgtggcagagctcgcttgggcactggccaccggcgcggagtacgtgcgcgccctggtcgaacagggcttcaacgccacagaggccttcgacacgatcaacttccgtgtcaccgccacccacgaccagttcctcacgatcgcccgtcttcgcgccctgcgcgaggcatgggcccgcatcggcgaggtctttggcgtggacgaggacaagcgcggcgctcgccagaatgcgatcaccagttggcgtgagctcacccgcgaagacccctatgtcaacatccttcgcggttcgattgccaccttctccgcctccgttggcggggccgagtcgatcacgacgctgcccttcacccaggccctcggcctgccggaggacgacttcccgctgcgcatcgcgcgcaacacgggcatcgtgctcgccgaagaggtgaacatcggccgcgtcaacgacccggccggtggctcctactacgtcgagtcgctcactcgcaccctggccgacgctgcctggaaggaattccaggaggtcgagaagctcggtggcatgtcgaaggcggtcatgaccgagcacgtcaccaaggtgctcgacgcctgcaatgccgagcgcgccaagcgcctggccaaccgcaagcagccgatcaccgcggtcagcgagttcccgatgatcggggcccgcagcatcgagaccaagccgttcccaaccgctccggcgcgcaagggcctggcctggcatcgcgattccgaggtgttcgagcagctgatggatcgctccaccagcgtctccgagcgccccaaggtgttccttgcctgcctgggcacccgtcgcgacttcggtggccgcgagggcttctccagcccggtatggcacatcgccggtatcgacaccccgcaggtcgaaggcggcaccaccgccgagatcgtcgaggcgttcaagaagtcgggcgcccaggtggccgatctctgctcgtccgccaagatctacgcgcagcagggacttgaggttgccaaggcgctcaaggccgccggcgcgaaggccctgtatctgtcgggcgccttcaaggagttcggcgatgacgccgccgaggccgagaagctgatcgacggacgcctgtacatgggcatggatgtcgtcgacaccctgtcctccacccttgatatcttgggagtcgcgaagtga

SEQ ID NO: 41 - DNA, 2187 bp, Artificial Sequence
  Description of Artificial Sequence: Synthetic polynucleotide
gtgagcactctgccccgttttgattcagttgacctgggcaatgccccggttcctgctgatgccgcacagcgcttcgaggagttggccgccaaggccggcaccgaagaggcgtgggagacggctgagcagattccggttggcaccctgttcaacgaagacgtctacaaggacatggactggctggacacctacgccggtatcccgccgttcgtccacggcccatatgcaaccatgtacgcgttccgtccctggacgattcgccagtacgccggcttctccacggccaaggagtccaacgccttctaccgccgcaaccttgcggcgggccagaagggcctgtcggttgccttcgacctgcccacccaccgcggctacgactcggacaatccccgcgtcgccggtgacgtcggcatggccggggtggccatcgactccatctatgacatgcgcgagctgttcgccggcattccgctggaccagatgagcgtgtcgatgaccatgaacggcgccgtgctgccgatcctggccctctatgtggtgaccgccgaggagcagggcgtcaagcccgagcagctcgccgggacgatccagaacgacatcctcaaggagttcatggttcgtaacacctatatctacccgccgcagccgagtatgcgaatcatctccgagatcttcgcctacacgagtgccaatatgccgaagtggaattcgatttccatttccggctaccacatgcaggaagccggcgccacggccgacatcgagatggcctacaccctggccgacggtgtcgactacatccgcgccggcgagtcggtgggcctcaatgtcgaccagttcgcgccgcgtctgtccttcttctggggcatcggcatgaacttcttcatggaggttgccaagctgcgtgccgcacgtatgttgtgggccaagctggtgcatcagttcgggccgaagaatccgaagtcgatgagcctgcgcacccactcgcagacctccggttggtcgctgaccgcccaggacgtctacaacaacgtcgtgcgtacctgcatcgaggccatggccgccacccagggccatacccagtcgctgcacacgaactcgctcgacgaggccattgccctaccgaccgatttcagcgcccgcatcgcccgtaacacccagctgttcctgcagcaggaatcgggcacgacgcgcgtgatcgacccgtggagcggctcggcatacgtcgaggagctcacctgggacctggcccgcaaggcatggggccacatccaggaggtcgagaaggtcggcggcatggccaaggccatcgaaaagggcatccccaagatgcgcattgaggaagccgccgcccgcacccaggcacgcatcgactccggccgtcagccgctgatcggcgtgaacaagtaccgcctggagcacgagccgccgctcgatgtgctcaaggttgacaactccacggtgctcgccgagcagaaggccaagctggtcaagctgcgcgccgagcgcgatcccgagaaggtcaaggccgccctcgacaagatcacctgggctgccgccaaccccgacgacaaggatccggatcgcaacctgctgaagctgtgcatcgacgctggccgcgccatggcgacggtcggcgagatgagcgacgcgctcgagaaggtcttcggacgctacaccgcccagattcgcaccatctccggtgtgtactcgaaggaagtgaagaacacgcctgaggttgaggaagcacgcgagctcgttgaggaattcgagcaggccgagggccgtcgtcctcgcatcctgctggccaagatgggccaggacggtcacgaccgtggccagaaggtcatcgccaccgcctatgccgacctcggtttcgacgtcgacgtgggcccgctgttccagaccccggaggagaccgcacgtcaggccgtcgaggccgatgtgcacgtggtgggcgtttcgtcgctcgccggcgggcatctgacgctggttccggccctgcgcaaggagctggacaagctcggacgtcccgacatcctcatcaccgtgggcggcgtgatccctgagcaggacttcgacgagctgcgtaaggacggcgccgtggagatctacacccccggcaccgtcattccggagtcggcgatctcgctggtcaagaaactgcgggcttcgctcgatgcctag

SEQ ID NO: 42 - DNA, 447 bp, Artificial Sequence
  Description of Artificial Sequence: Synthetic polynucleotide
atgagtaatgaggatcttttcatctgtatcgatcacgtggcatatgcgtgccccgacgccgacgaggcttccaagtactaccaggagaccttcggctggcatgagctccaccgcgaggagaacccggagcagggagtcgtcgagatcatgatggccccggctgcgaagctgaccgagcacatgacccaggttcaggtcatggccccgctcaacgacgagtcgaccgttgccaagtggcttgccaagcacaatggtcgcgccggactgcaccacatggcatggcgtgtcgatgacatcgacgccgtcagcgccaccctgcgcgagcgcggcgtgcagctgctgtatgacgagcccaagctcggcaccggcggcaaccgcatcaacttcatgcatcccaagtcgggcaagggcgtgctcatcgagctcacccagtacccgaagaactga

SEQ ID NO: 43 - DNA, 1575 bp, Artificial Sequence
  Description of Artificial Sequence: Synthetic polynucleotide
atggctgaaaacaacaatttgaagctcgccagcaccatggaaggtcgcgtggagcagctcgcagagcagcgccaggtgatcgaagccggtggcggcgaacgtcgcgtcgagaagcaacattcccagggtaagcagaccgctcgtgagcgcctgaacaacctgctcgatccccattcgttcgacgaggtcggcgctttccgcaagcaccgcaccacgttgttcggcatggacaaggccgtcgtcccggcagatggcgtggtcaccggccgtggcaccatccttggtcgtcccgtgcacgccgcgtcccaggacttcacggtcatgggtggttcggctggcgagacgcagtccacgaaggtcgtcgagacgatggaacaggcgctgctcaccggcacgcccttcctgttcttctacgattcgggcggcgcccggatccaggagggcatcgactcgctgagcggttacggcaagatgttcttcgccaacgtgaagctgtcgggcgtcgtgccgcagatcgccatcattgccggcccctgtgccggtggcgcctcgtattcgccggcactgactgacttcatcatcatgaccaagaaggcccatatgttcatcacgggcccccaggtcatcaagtcggtcaccggcgaggatgtcaccgctgacgaactcggtggcgctgaggcccatatggccatctcgggcaatatccacttcgtggccgaggacgacgacgccgcggagctcattgccaagaagctgctgagcttccttccgcagaacaacactgaggaagcatccttcgtcaacccgaacaatgacgtcagccccaataccgagctgcgcgacatcgttccgattgacggcaagaagggctatgacgtgcgcgatgtcattgccaagatcgtcgactggggtgactacctcgaggtcaaggccggctatgccaccaacctcgtgaccgccttcgcccgggtcaatggtcgttcggtgggcatcgtggccaatcagccgtcggtgatgtcgggttgcctcgacatcaacgcctctgacaaggccgccgaattcgtgaatttctgcgattcgttcaacatcccgctggtgcagctggtcgacgtgccgggcttcctgcccggcgtgcagcaggagtacggcggcatcattcgccatggcgcgaagatgctgtacgcctactccgaggccaccgtgccgaagatcaccgtggtgctccgcaaggcctacggcggctcctacctggccatgtgcaaccgtgaccttggtgccgacgccgtgtacgcctggcccagcgccgagattgcggtgatgggcgccgagggtgcggcaaatgtgatcttccgcaaggagatcaaggctgccgacgatcccgacgccatgcgcgccgagaagatcgaggagtaccagaacgcgttcaacacgccgtacgtggccgccgcccgcggtcaggtcgacgacgtgattgacccggctgatacccgtcgaaagattgcttccgccctggagatgtacgccaccaagcgtcagacccgcccggcgaagaagcatggaaacttcccctgctga

SEQ ID NO: 44 - DNA, 1518 bp, Artificial Sequence
  Description of Artificial Sequence: Synthetic polynucleotide
atgagtccgcgagaaattgaggtttccgagccgcgcgaggttggtatcaccgagctcgtgctgcgcgatgcccatcagagcctgatggccacacgaatggcaatggaagacatggtcggcgcctgtgcagacattgatgctgccgggtactggtcagtggagtgttggggtggtgccacgtatgactcgtgtatccgcttcctcaacgaggatccttgggagcgtctgcgcacgttccgcaagctgatgcccaacagccgtctccagatgctgctgcgtggccagaacctgctgggttaccgccactacaacgacgaggtcgtcgatcgcttcgtcgacaagtccgctgagaacggcatggacgtgttccgtgtcttcgacgccatgaatgatccccgcaacatggcgcacgccatggctgccgtcaagaaggccggcaagcacgcgcagggcaccatttgctacacgatcagcccggtccacaccgttgagggctatgtcaagcttgctggtcagctgctcgacatgggtgctgattccatcgccctgaaggacatggccgccctgctcaagccgcagccggcctacgacatcatcaaggccatcaaggacacctacggccagaagacgcagatcaacctgcactgccactccaccacgggtgtcaccgaggtctccctcatgaaggccatcgaggccggcgtcgacgtcgtcgacaccgccatctcgtccatgtcgctcggcccgggccacaaccccaccgagtcggttgccgagatgctcgagggcaccgggtacaccaccaaccttgactacgatcgcctgcacaagatccgcgatcacttcaaggccatccgcccgaagtacaagaagttcgagtcgaagacgcttgtcgacacctcgatcttcaagtcgcagatccccggcggcatgctctccaacatggagtcgcagctgcgcgcccagggcgccgaggacaagatggacgaggtcatggcagaggtgccgcgcgtccgcaaggccgccggcttcccgcccctggtcaccccgtccagccagatcgtcggcacgcaggccgtgttcaacgtgatgatgggcgagtacaagaggatgaccggcgagttcgccgacatcatgctcggctactacggcgccagcccggccgatcgcgatccgaaggtggtcaagttggccgaggagcagtccggcaagaagccgatcacccagcgcccggccgatctgctgccccccgagtgggaggagcagtccaaggaggccgcggccctcaagggcttcaacggcaccgacgaggacgtgctcacctatgcactgttcccgcaggtcgctccggtcttcttcgagcatcgcgccgagggcccgcacagcgtggctctcaccgatgcccagctgaaggccgaggccgagggcgacgagaagtcgctcgccgtggccggtcccgtcacctacaacgtgaacgtgggcggaaccgtccgcgaagtcaccgttcagcaggcgtga

SEQ ID NO: 45 - DNA, 372 bp, Artificial Sequence
  Description of Artificial Sequence: Synthetic polynucleotide
atgaaactgaaggtaacagtcaacggcactgcgtatgacgttgacgttgacgtcgacaagtcacacgaaaacccgatgggcaccatcctgttcggcggcggcaccggcggcgcgccggcaccgcgcgcagcaggtggcgcaggcgccggtaaggccggagagggcgagattcccgctccgctggccggcaccgtctccaagatcctcgtgaaggagggtgacacggtcaaggctggtcagaccgtgctcgttctcgaggccatgaagatggagaccgagatcaacgctcccaccgacggcaaggtcgagaaggtccttgtcaaggagcgtgacgccgtgcagggcggtcagggtctcatcaagatcggctga

SEQ ID NO: 46 - protein, 524 aa, Artificial Sequence
  Description of Artificial Sequence: Synthetic polypeptide
MRKVPIITADEAAKLIKDGDTVTTSGFVGNAIPEALDRAVEKRFLETGEPKNITYVYCGSQGNRDGRGAEHFAHEGLLKRYIAGHWATVPALGKMAMENKMEAYNVSQGALCHLFRDIASHKPGVFTKVGIGTFIDPRNGGGKVNDITKEDIVELVEIKGQEYLFYPAFPIHVALIRGTYADESGNITFEKEVAPLEGTSVCQAVKNSGGIVVVQVERVVKAGTLDPRHVKVPGIYVDYVVVADPEDHQQSLDCEYDPALSGEHRRPEVVGEPLPLSAKKVIGRRGAIELEKDVAVNLGVGAPEYVASVADEEGIVDFMTLTAESGAIGGVPAGGVRFGASYNADALIDQGYQFDYYDGGGLDLCYLGLAECDEKGNINVSRFGPRIAGCGGFINITQNTPKVFFCGTFTAGGLKVKIEDGKVIIVQEGKQKKFLKAVEQITFNGDVALANKQQVTYITERCVFLLKEDGLHLSEIAPGIDLQTQILDVMDFAPIIDRDANGQIKLMDAALFAEGLMGLKEMKS

SEQ ID NO: 47 - protein, 422 aa, Artificial Sequence
  Description of Artificial Sequence: Synthetic polypeptide
MSLTQGMKAKQLLAYFQGKADQDAREAKARGELVCWSASVAPPEFCVTMGIAMIYPETHAAGIGARKGAMDMLEVADRKGYNVDCCSYGRVNMGYMECLKEAAITGVKPEVLVNSPAADVPLPDLVITCNNICNTLLKWYENLAAELDIPCIVIDVPFNHTMPIPEYAKAYIADQFRNAISQLEVICGRPFDWKKFKEVKDQTQRSVYHWNRIAEMAKYKPSPLNGFDLFNYMALIVACRSLDYAEITFKAFADELEENLKAGIYAFKGAEKTRFQWEGIAVWPHLGHTFKSMKNLNSIMTGTAYPALWDLHYDANDESMHSMAEAYTRIYINTCLQNKVEVLLGIMEKGQVDGTVYHLNRSCKLMSFLNVETAEIIKEKNGLPYVSIDGDQTDPRVFSPAQFDTRVQALVEMMEANMAAAE

SEQ ID NO: 48 - protein, 374 aa, Artificial Sequence
  Description of Artificial Sequence: Synthetic polypeptide
MSRVEAILSQLKDVAANPKKAMDDYKAETGKGAVGIMPIYSPEEMVHAAGYLPMGIWGAQGKTISKARTYLPAFACSVMQQVMELQCEGAYDDLSAVIFSVPCDTLKCLSQKWKGTSPVIVFTHPQNRGLEAANQFLVTEYELVKAQLESVLGVKISNAALENSIAIYNENRAVMREFVKVAADYPQVIDAVSRHAVFKARQFMLKEKHTALVKELIAEIKATPVQPWDGKKVVVTGILLEPNELLDIFNEFKIAIVDDDLAQESRQIRVDVLDGEGGPLYRMAKAWQQMYGCSLATDTKKGRGRMLINKTIQTGADAIVVAMMKFCDPEEWDYPVMYREFEEKGVKSLMIEVDQEVSSFEQIKTRLQSFVEML

SEQ ID NO: 49 - protein, 260 aa, Artificial Sequence
  Description of Artificial Sequence: Synthetic polypeptide
  MOD_RES (260)..(260): Any amino acid
MYTLGIDVGSASSKAVILKDGKDIVAAEVVQVGTGSSGPQRALDKAFEVSGLKKEDISYTVATGYGRFNFSDADKQISEISCHAKGIYFLVPTARTIIDIGGQDAKAIRLDDKGGIKQFFMNDKCAAGTGRFLEVMARVLETTLDEMAELDEQATDTAPISSTCTVFAESEVISQLSNGVSRNNIIKGVHLSVASRACGLAYRGGLEKDVVMTGGVAKNAGVVRAVAGVLKTDVIVAPNPQTTGALGAALYAYEAAQKKX

SEQ ID NO: 50 - protein, 367 aa, Artificial Sequence
  Description of Artificial Sequence: Synthetic polypeptide
MAFNSADINSFRDIWVFCEQREGKLINTDFELISEGRKLADERGSKLVGILLGHEVEEIAKELGGYGADKVIVCDHPELKFYTTDAYAKVLCDVVMEEKPEVILIGATNIGRDLGPRCAARLHTGLTADCTHLDIDMNKYVDFLSTSSTLDISSMTFPMEDTNLKMTRPAFGGHLMATIICPRFRPCMSTVRPGVMKKAEFSQEMAQACQVVTRHVNLSDEDLKTKVINIVKETKKIVDLIGAEIIVSVGRGISKDVQGGIALAEKLADAFGNGVVGGSRAVIDSGWLPADHQVGQTGKTVHPKVYVALGISGAIQHKAGMQDSELIIAVNKDETAPIFDCADYGITGDLFKIVPMMIDAIKEGKNA

SEQ ID NO: 51 - protein, 267 aa, Artificial Sequence
  Description of Artificial Sequence: Synthetic polypeptide
MRIYVCVKQVPDTSGKVAVNPDGTLNRASMAAIINPDDMSAIEQALKLKDETGCQVTALTMGPPPAEGMLREIIAMGADDGVLISAREFGGSDTFATSQIISAAIHKLGLSNEDMIFCGRQAIDGDTAQVGPQIAEKLSIPQVTYGAGIKKSGDLVLVKRMLEDGYMMIEVETPCLITCIQDKAVKPRYMTLNGIMECYSKPLLVLDYEALKDEPLIELDTIGLKGSPTNIFKSFTPPQKGVGVMLQGTDKEKVEDLVDKLMQKHVI

SEQ ID NO: 52 - protein, 394 aa, Artificial Sequence
  Description of Artificial Sequence: Synthetic polypeptide
MFLLKIKKERMKRMDFSLTREQEMLKKLARQFAEIELEPVAEEIDREHVFPAENFKKMAEIGLTGIGIPKEFGGSGGGTLEKVIAVSEFGKKCMASASILSIHLIAPQAIYKYGTKEQKETYLPRLTKGGELGAFALTEPNAGSDAGAVKTTAILDSQTNEYVLNGTKCFISGGGRAGVLVIFALTEPKKGLKGMSAIIVEKGTPGFSIGKVESKMGIAGSETAELIFEDCRVPAANLLGKEGKGFKIAMEALDGARIGVGAQAIGIAEGAIDLSVKYVHERIQFGKPIANLQGIQWYIADMATKTAAARALVEFAAYLEDAGKPFTKESAMCKLNASENARFVTNLALQIHGGYGYMKDYPLERMYRDAKITEIYEGTSEIHKVVIAREVMKR

SEQ ID NO: 53 - protein, 820 aa, Artificial Sequence
  Description of Artificial Sequence: Synthetic polypeptide
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQRSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 54 - protein, 310 aa, Artificial Sequence
  Description of Artificial Sequence: Synthetic polypeptide
MVKVYAPASSANMSVGFDVLGAAVTPVDGALLGDVVTVEAAETFSLNNLGRFADKLPSEPRENIVYQCWERFCQELGKQIPVAMTLEKNMPIGSGLGSSACSVVAALMAMNEHCGKPLNDTRLLALMGELEGRISGSIHYDNVAPCFLGGMQLMIEENDIISQQVPGFDEWLWVLAYPGIKVSTAEARAILPAQYRRQDCIAHGRHLAGFIHACYSRQPELAAKLMKDVIAEPYRERLLPGFRQARQAVAEIGAVASGISGSGPTLFALCDKPETAQRVADWLGKNYLQNQEGFVHICRLDTAGARVLEN

SEQ ID NO: 55 - protein, 428 aa, Artificial Sequence
  Description of Artificial Sequence: Synthetic polypeptide
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQETRNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 56 - protein, 436 aa, Artificial Sequence
  Description of Artificial Sequence: Synthetic polypeptide
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSAVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 57 - protein, 887 aa, Artificial Sequence
  Description of Artificial Sequence: Synthetic polypeptide
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 58 - protein, 630 aa, Artificial Sequence
  Description of Artificial Sequence: Synthetic polypeptide
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 59 - protein, 474 aa, Artificial Sequence
  Description of Artificial Sequence: Synthetic polypeptide
MSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTKPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 60 - protein, 326 aa, Artificial Sequence
  Description of Artificial Sequence: Synthetic polypeptide
MRAVLIEKSDDTQSVSVTELAEDQLPEGDVLVDVAYSTLNYKDALAITGKAPVVRRFPMVPGIDFTGTVAQSSHADFKPGDRVILNGWGVGEKHWGGLAERARVRGDWLVPLPAPLDLRQAAMIGTAGYTAMLCVLALERHGVVPGNGEIVVSGAAGGVGSVATTLLAAKGYEVAAVTGRASEAEYLRGLGAASVIDRNELTGKVRPLGQERWAGGIDVAGSTVLANMLSMMKYRGVVAACGLAAGMDLPASVAPFILRGMTLAGVDSVMCPKTDRLAAWARLASDLDPAKLEEMTTELPFSEVIETAPKFLDGTVRGRIVIPVTP

SEQ ID NO: 61 - protein, 714 aa, Artificial Sequence
  Description of Artificial Sequence: Synthetic polypeptide
MSNVQEWQQLANKELSRREKTVDSLVHQTAEGIAIKPLYTEADLDNLEVTGTLPGLPPYVRGPRATMYTAQPWTIRQYAGFSTAKESNAFYRRNLAAGQKGLSVAFDLATHRGYDSDNPRVAGDVGKAGVAIDTVEDMKVLFDQIPLDKMSVSMTMNGAVLPVLAFYIVAAEEQGVTPDKLTGTIQNDILKEYLCRNTYIYPPKPSMRIIADIIAWCSGNMPRFNTISISGYHMGEAGANCVQQVAFTLADGIEYIKAAISAGLKIDDFAPRLSFFFGIGMDLFMNVAMLRAARYLWSEAVSGFGAQDPKSLALRTHCQTSGWSLTEQDPYNNVIRTTIEALAATLGGTQSLHTNAFDEALGLPTDFSARIARNTQIIIQEESELCRTVDPLAGSYYIESLTDQIVKQARAIIQQIDEAGGMAKAIEAGLPKRMIEEASAREQSLIDQGKRVIVGVNKYKLDHEDETDVLEIDNVMVRNEQIASLERIRATRDDAAVTAALNALTHAAQHNENLLAAAVNAARVRATLGEISDALEVAFDRYLVPSQCVTGVIAQSYHQSEKSASEFDAIVAQTEQFLADNGRRPRILIAKMGQDGHDRGAKVIASAYSDLGFDVDLSPMFSTPEEIARLAVENDVHVVGASSLAAGHKTLIPELVEALKKWGREDICVVAGGVIPPQDYAFLQERGVAAIYGPGTPMLDSVRDVLNLISQHHD

SEQ ID NO: 62 - protein, 331 aa, Artificial Sequence
  Description of Artificial Sequence: Synthetic polypeptide
MINEATLAESIRRLRQGERATLAQAMTLVESRHPRHQALSTQLLDAIMPYCGNTLRLGVTGTPGAGKSTFLEAFGMLLIREGLKVAVIAVDPSSPVTGGSILGDKTRMNDLARAEAAFIRPVPSSGHLGGASQRARELMLLCEAAGYDVVIVETVGVGQSETEVARMVDCFISLQIAGGGDDLQGIKKGLMEVADLIVINKDDGDNHTNVAIARHMYESALHILRRKYDEWQPRVLTCSALEKRGIDEIWHAIIDFKTALTASGRLQQVRQQQSVEWLRKQTEEEVLNHLFANEDFDRYYRQTLLAVKNNTLSPRTGLRQLSEFIQTQYFD

SEQ ID NO: 63 - protein, 261 aa, Artificial Sequence
  Description of Artificial Sequence: Synthetic polypeptide
MSYQYVNVVTINKVAVIEFNYGRKLNALSKVFIDDLMQALSDLNRPEIRCIILRAPSGSKVFSAGHDIHELPSGGRDPLSYDDPLRQITRMIQKFPKPIISMVEGSVWGGAFEMIMSSDLIIAASTSTFSMTPVNLGVPYNLVGIHNLTRDAGFHIVKELIFTASPITAQRALAVGILNHVVEVEELEDFTLQMAHHISEKAPLAIAVIKEELRVLGEAHTMNSDEFERIQGMRRAVYDSEDYQEGMNAFLEKRKPNFVGH

SEQ ID NO: 64 - protein, 492 aa, Artificial Sequence
  Description of Artificial Sequence: Synthetic polypeptide
METQWTRMTANEAAEIIQHNDMVAFSGFTPAGSPKALPTAIARRANEQHEAKKPYQIRLLTGASISAAADDVLSDADAVSWRAPYQTSSGLRKKINQGAVSFVDLHLSEVAQMVNYGFFGDIDVAVIEASALAPDGRVWLTSGIGNAPTWLLRAKKVIIELNHYHDPRVAELADIVIPGAPPRRNSVSIFHAMDRVGTRYVQIDPKKIVAVVETNLPDAGNMLDKQNPMCQQIADNVVTFLLQEMAHGRIPPEFLPLQSGVGNINNAVMARLGENPVIPPFMMYSEVLQESVVHLLETGKISGASASSLTISADSLRKIYDNMDYFASRIVLRPQEISNNPEIIRRLGVIALNVGLEFDIYGHANSTHVAGVDLMNGIGGSGDFERNAYLSIFMAPSIAKEGKISTVVPMCSHVDHSEHSVKVIITEQGIADLRGLSPLQRARTIIDNCAHPMYRDYLHRYLENAPGGHIHHDLSHVFDLHRNLIATGSMLG

SEQ ID NO: 65 - protein, 638 aa, Artificial Sequence
  Description of Artificial Sequence: Synthetic polypeptide
MSSTDQGTNPADTDDLTPTTLSLAGDFPKATEEQWEREVEKVFNRGRPPEKQLTFAECLKRLTVHTVDGIDIVPMYRPKDAPKKLGYPGVTPFTRGTTVRNGDMDAWDVRALHEDPDEKFTRKAILEDLERGVTSLLLRVDPDAIAPEHLDEVLSDVLLEMTKVEVFSRYDQGAAAEALMGVYERSDKPAKDLALNLGLDPIGFAALQGTEPDLTVLGDWVRRLAKFSPDSRAVTIDANVYHNAGAGDVAELAWALATGAEYVRALVEQGFNATEAFDTINFRVTATHDQFLTIARLRALREAWARIGEVFGVDEDKRGARQNAITSWRELTREDPYVNILRGSIATFSASVGGAESITTLPFTQALGLPEDDFPLRIARNTGIVLAEEVNIGRVNDPAGGSYYVESLTRTLADAAWKEFQEVEKLGGMSKAVMTEHVTKVLDACNAERAKRLANRKQPITAVSEFPMIGARSIETKPFPTAPARKGLAWHRDSEVFEQLMDRSTSVSERPKVFLACLGTRRDFGGREGFSSPVWHIAGIDTPQVEGGTTAEIVEAFKKSGAQVADLCSSAKIYAQQGLEVAKALKAAGAKALYLSGAFKEFGDDAAEAEKLIDGRLYMGMDVVDTLSSTLDILGVAK

SEQ ID NO: 66 - protein, 728 aa, Artificial Sequence
  Description of Artificial Sequence: Synthetic polypeptide
VSTLPRFDSVDLGNAPVPADAAQRFEELAAKAGTEEAWETAEQIPVGTLFNEDVYKDMDWLDTYAGIPPFVHGPYATMYAFRPWTIRQYAGFSTAKESNAFYRRNLAAGQKGLSVAFDLPTHRGYDSDNPRVAGDVGMAGVAIDSIYDMRELFAGIPLDQMSVSMTMNGAVLPILALYVVTAEEQGVKPEQLAGTIQNDILKEFMVRNTYIYPPQPSMRIISEIFAYTSANMPKWNSISISGYHMQEAGATADIEMAYTLADGVDYIRAGESVGLNVDQFAPRLSFFWGIGMNFFMEVAKLRAARMLWAKLVHQFGPKNPKSMSLRTHSQTSGWSLTAQDVYNNVVRTCIEAMAATQGHTQSLHTNSLDEAIALPTDFSARIARNTQLFLQQESGTTRVIDPWSGSAYVEELTWDLARKAWGHIQEVEKVGGMAKAIEKGIPKMRIEEAAARTQARIDSGRQPLIGVNKYRLEHEPPLDVLKVDNSTVLAEQKAKLVKLRAERDPEKVKAALDKITWAAANPDDKDPDRNLLKLCIDAGRAMATVGEMSDALEKVFGRYTAQIRTISGVYSKEVKNTPEVEEARELVEEFEQAEGRRPRILLAKMGQDGHDRGQKVIATAYADLGFDVDVGPLFQTPEETARQAVEADVHVVGVSSLAGGHLTLVPALRKELDKLGRPDILITVGGVIPEQDFDELRKDGAVEIYTPGTVIPESAISLVKKLRASLDA

SEQ ID NO: 67 - protein, 148 aa, Artificial Sequence
  Description of Artificial Sequence: Synthetic polypeptide
MSNEDLFICIDHVAYACPDADEASKYYQETFGWHELHREENPEQGVVEIMMAPAAKLTEHMTQVQVMAPLNDESTVAKWLAKHNGRAGLHHMAWRVDDIDAVSATLRERGVQLLYDEPKLGTGGNRINFMHPKSGKGVLIELTQYPKN

SEQ ID NO: 68 - protein, 524 aa, Artificial Sequence
  Description of Artificial Sequence: Synthetic polypeptide
MAENNNLKLASTMEGRVEQLAEQRQVIEAGGGERRVEKQHSQGKQTARERLNNLLDPHSFDEVGAFRKHRTTLFGMDKAVVPADGVVTGRGTILGRPVHAASQDFTVMGGSAGETQSTKVVETMEQALLTGTPFLFFYDSGGARIQEGIDSLSGYGKMFFANVKLSGVVPQIAIIAGPCAGGASYSPALTDFIIMTKKAHMFITGPQVIKSVTGEDVTADELGGAEAHMAISGNIHFVAEDDDAAELIAKKLLSFLPQNNTEEASFVNPNNDVSPNTELRDIVPIDGKKGYDVRDVIAKIVDWGDYLEVKAGYATNLVTAFARVNGRSVGIVANQPSVMSGCLDINASDKAAEFVNFCDSFNIPLVQLVDVPGFLPGVQQEYGGIIRHGAKMLYAYSEATVPKITVVLRKAYGGSYLAMCNRDLGADAVYAWPSAEIAVMGAEGAANVIFRKEIKAADDPDAMRAEKIEEYQNAFNTPYVAAARGQVDDVIDPADTRRKIASALEMYATKRQTRPAKKHGNFPC

SEQ ID NO: 69 - protein, 505 aa, Artificial Sequence
  Description of Artificial Sequence: Synthetic polypeptide
MSPREIEVSEPREVGITELVLRDAHQSLMATRMAMEDMVGACADIDAAGYWSVECWGGATYDSCIRFLNEDPWERLRTFRKLMPNSRLQMLLRGQNLLGYRHYNDEVVDRFVDKSAENGMDVFRVFDAMNDPRNMAHAMAAVKKAGKHAQGTICYTISPVHTVEGYVKLAGQLLDMGADSIALKDMAALLKPQPAYDIIKAIKDTYGQKTQINLHCHSTTGVTEVSLMKAIEAGVDVVDTAISSMSLGPGHNPTESVAEMLEGTGYTTNLDYDRLHKIRDHFKAIRPKYKKFESKTLVDTSIFKSQIPGGMLSNMESQLRAQGAEDKMDEVMAEVPRVRKAAGFPPLVTPSSQIVGTQAVFNVMMGEYKRMTGEFADIMLGYYGASPADRDPKVVKLAEEQSGKKPITQRPADLLPPEWEEQSKEAAALKGFNGTDEDVLTYALFPQVAPVFFEHRAEGPHSVALTDAQLKAEAEGDEKSLAVAGPVTYNVNVGGTVREVTVQQA

SEQ ID NO: 70 - protein, 123 aa, Artificial Sequence
  Description of Artificial Sequence: Synthetic polypeptide
MKLKVTVNGTAYDVDVDVDKSHENPMGTILFGGGTGGAPAPRAAGGAGAGKAGEGEIPAPLAGTVSKILVKEGDTVKAGQTVLVLEAMKMETEINAPTDGKVEKVLVKERDAVQGGQGLIKIG

SEQ ID NO: 71 - DNA, 7584 bp, Artificial Sequence
  Description of Artificial Sequence: Synthetic polynucleotide
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaatacgcatggcatggatgaccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcgtgc

SEQ ID NO: 72 - DNA, 623 bp, Artificial Sequence
  Description of Artificial Sequence: Synthetic polynucleotide
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacat

SEQ ID NO: 73 - DNA, 124 bp, Artificial Sequence
  Description of Artificial Sequence: Synthetic polynucleotide
cattaattcctaatttttgttgacactctatcattgatagagttattttaccactccctatcagtgatagagaaaagtgaactctagaaataattttgtttaactttaagaaggagatatacat

SEQ ID NO: 74 - DNA, 1562 bp, Artificial Sequence
  Description of Artificial Sequence: Synthetic polynucleotide
atgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 75 - protein, 520 aa, Artificial Sequence
  Description of Artificial Sequence: Synthetic polypeptide
MQTQKPTLELLTCEGAYRDNPTALFHQLCGDRPATLLLESADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 76 - DNA, 1596 bp, Artificial Sequence
  Description of Artificial Sequence: Synthetic polynucleotide
atggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaa

SEQ ID NO: 77 - protein, 531 aa, Artificial Sequence
  Description of Artificial Sequence: Synthetic polypeptide
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPTNTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 78 - DNA, 1359 bp, Artificial Sequence
  Description of Artificial Sequence: Synthetic polynucleotide
atgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaa

SEQ ID NO: 79 - protein, 452 aa, Artificial Sequence
  Description of Artificial Sequence: Synthetic polypeptide
MQTVLAKIVADKAIWVETRKEQQPLASFQNEVQPSTRHFYDALQGARTAFILECKKASPSKGVIRDDFDPARIAAIYKHYASAISVLTDEKYFQGSFDFLPIVSQIAPQPILCKDFIIDPYQIYLARYYQADACLLMLSVLDDEQYRQLAAVAHSLEMGVLTEVSNEEELERAIALGAKVVGINNRDLRDLSIDLNRTRELAPKLGHNVTVISESGINTYAQVRELSHFANGFLIGSALMAHDDLNAAVRRVLLGENKVCGLTRGQDAKAAYDAGAIYGGLIFVATSPRCVNVEQAQEVMAAAPLQYVGVFRNHDIADVADKAKVLSLAAVQLHGNEDQLYIDNLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 80 - DNA, 1194 bp, Artificial Sequence
  Description of Artificial Sequence: Synthetic polynucleotide
atgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctga

SEQ ID NO: 81 - protein, 397 aa, Artificial Sequence
  Description of Artificial Sequence: Synthetic polypeptide
MTTLLNPYFGEFGGMYVPQILMPALRQLEEAFVSAQKDPEFQAQFNDLLKNYAGRPTALTKCQNITAGTNTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYETAHYMLGTAAGPHPYPTIVREFQRMIGEETKAQILEREGRLPDAVIACVGGGSNAIGMFADFINETDVGLIGVEPGGHGIETGEHGAPLKHGRVGIYFGMKAPMMQTEDGQIEESYSISAGLDFPSVGPQHAYLNSTGRADYVSITDDEALEAFKTLCLHEGIIPALESSHALAHALKMMRENPEKEQLLVVNLSGRGDKDIFTVHDILKARGEI

SEQ ID NO: 82 - DNA, 807 bp, Artificial Sequence
  Description of Artificial Sequence: Synthetic polynucleotide
atggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 83 - protein, 268 aa, Artificial Sequence
  Description of Artificial Sequence: Synthetic polypeptide
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 84 - protein, 350 aa, Escherichia coli
MNYQNDDLRIKEIKELLPPVALLEKFPATENAANTVAHARKAIHKILKGNDDRLLVVIGPCSIHDPVAAKEYATRLLTLREELQDELEIVMRVYFEKPRTTVGWKGLINDPHMDNSFQINDGLRIARKLLLDINDSGLPAAGEFLDMITLQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCTDVCQQIAGGEKAIIGVMVESHLVEGNQSLESGEPLAYGKSITDACIGWDDTDALLRQLASAVKARRG

SEQ ID NO: 85 - protein, 520 aa, Escherichia coli
MQTQKPTLELLTCEGAYRDNPTALFHQLCGDRPATLLLEFADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 86 - protein, 410 aa, Escherichia coli
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 87 - protein, 410 aa, Escherichia coli
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIAEARPGVLTALNKIFAEQGVNIAAQYLQTSAQMGYVVIDIEADEDVAEKALQAMKAIPGTIRARLLY

SEQ ID NO: 88 - protein, 471 aa, Escherichia coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKVMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 89 - protein, 416 aa, Pseudomonas fluorescens
MTTRNDCLALDAQDSLAPLRQQFALPEGVIYLDGNSLGARPVAALARAQAVIAEEWGNGLIRSWNSAGWRDLSERLGNRLATLIGARDGEVVVTDTTSINLFKVLSAALRVQATRSPERRVIVTETSNFPTDLYIAEGLADMLQQGYTLRLVDSPEELPQAIDQDTAVVMLTHVNYKTGYMHDMQALTALSHECGALAIWDLAHSAGAVPVDLHQAGADYAIGCTYKYLNGGPGSQAFVWVSPQLCDLVPQPLSGWFGHSRQFAMEPRYEPSNGIARYLCGTQPITSLAMVECGLDVFAQTDMASLRRKSLALTDLFIELVEQRCAAHELTLVTPREHAKRGSHVSFEHPEGYAVIQALIDRGVIGDYREPRIMRFGFTPLYTTFTEVWDAVQILGEILDRKTWAQAQFQVRHSVT

SEQ ID NO: 90 - protein, 465 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 91 - protein, 378 aa, Shewanella oneidensis
MLLNVKQDFCLAGPGYLLNHSVGRPLKSTEQALKQAFFAPWQESGREPWGQWLGVIDNFTAALASLFNGQPQDFCPQVNLSSALTKIVMSLDRLTRDLTRNGGAVVLMSEIDFPSMGFALKKALPASCELRFIPKSLDVTDPNVWDAHICDDVDLVFVSHAYSNTGQQAPLAQIISLARERGCLSLVDVAQSAGILPLDLAKLQPDFMIGSSVKWLCSGPGAAYLWVNPAILPECQPQDVGWFSHENPFEFDIHDFRYHPTALRFWGGTPSIAPYAIAAHSIEYFANIGSQVMREHNLQLMEPVVQALDNELVSPQEVDKRSGTIILQFGERQPQILAALAAANISVDTRSLGIRVSPHIYNDEADIARLLGVIKANR

SEQ ID NO: 92 - DNA, 1424 bp, Artificial Sequence
  Description of Artificial Sequence: Synthetic polynucleotide
atctaatctagacatcattaattcctaatttttgttgacactctatcattgatagagttattttaccactccctatcagtgatagagaaaagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaaaaataaaacgaaaggctcagtcgaaagactgggcctttcgttttatctgttg

SEQ ID NO: 93 - DNA, 1571 bp, Artificial Sequence
  Description of Artificial Sequence: Synthetic polynucleotide
atctaatctagacatcattaattcctaatttttgttgacactctatcattgatagagttattttaccactccctatcagtgatagagaaaagtgaatatcaagacacgaggaggtaagattatggagccttcatctttagaactgccagcggacacggtgcagcgcatcgcggcggaactgaagtgccatccgactgatgagcgtgtggcgctgcatctggacgaagaagataaactgcgccactttcgtgaatgtttttatattcctaaaattcaagacttgccgccggtagatttgagtctcgttaacaaagatgaaaacgcgatctactttctgggcaactctctgggtctgcaaccaaaaatggttaaaacgtacctggaggaagaactggataaatgggcaaaaatcgcggcttatggtcacgaagtgggcaagcgtccttggattactggcgacgagtctattgtgggtttgatgaaagatattgtgggcgcgaatgaaaaggaaattgcactgatgaatgctctgaccgttaatctgcacctgctgatgctgtctttttttaaaccgaccccgaaacgctacaaaatactgctggaagcgaaagcgtttccgtcggatcactatgctatagaaagtcaactgcagttgcatggtctgaatatcgaggaatctatgcgcatgattaaaccgcgtgagggtgaagaaacgctgcgtattgaagacattctggaagttattgaaaaagaaggtgattctatcgcagttatactgttttctggcgtgcacttttatacaggtcagcacttcaatatcccggcaatcactaaagcggggcaggcaaaaggctgctatgttggttttgacctggcgcatgcagtggggaatgttgaactgtatctgcacgattggggcgttgatttcgcgtgttggtgtagctacaaatatctgaacgctggcgcgggtggcattgctggcgcttttattcacgaaaaacacgcgcacaccattaaaccggctctggttggctggttcggtcatgagctgagtactcgctttaaaatggataacaaactgcaattgattccgggtgtttgcggcttccgtatcagcaatccgccgattctgctggtttgcagcctgcacgctagtctggaaatctttaagcaggcgactatgaaagcgctgcgcaaaaaatctgtgctgctgaccggctatctggagtatctgatcaaacacaattatggcaaagataaagctgcaactaaaaaaccggtagtgaacattatcaccccctcacacgtggaggagcgcggttgtcagctgactattactttcagtgtacctaataaagatgtgttccaggaactggaaaaacgcggcgttgtttgtgataaacgtaacccgaatggtattcgcgtggctcctgtgccgctgtacaattcattccacgatgtttataaattcaccaacctgctgacttctattctcgacagtgctgagactaaaaattaaaaataaaacgaaaggctcagtcgaaagactgggcctttcgttttatctgttg

SEQ ID NO: 94 - DNA, 1310 bp, Artificial Sequence
  Description of Artificial Sequence: Synthetic polynucleotide
atctaatctagacatcattaattcctaatttttgttgacactctatcattgatagagttattttaccactccctatcagtgatagagaaaagtgaatggttcaccaccacaaggagggattatgctgctgaatgtaaaacaggacttttgcctggcaggcccgggctacctgctgaatcactcggttggccgtccgctgaaatcaactgagcaagcgctgaaacaagcattttttgctccgtggcaagagagcggtcgtgaaccgtggggccagtggctgggtgttattgataatttcactgctgcgctggcatctctgtttaatggtcaaccgcaggatttttgtccgcaggttaacctgagcagcgcgctgactaaaattgtgatgtcactggatcgtctgactcgcgatctgacccgcaatggcggtgctgttgtgctgatgtctgaaatcgatttcccatctatgggcttcgcgttgaaaaaagcgctgccagcgagctgcgaactgcgttttatcccgaaaagtctggacgtgactgatccgaacgtatgggatgcacacatctgtgatgatgtagacctggtttttgtgtctcacgcctatagtaatacgggccaacaggctccgctggcgcaaatcatctctctggcgcgtgaacgtggctgcctgtcactggtggatgtagcgcaatcagcggggattttgccgctggatctggcgaaactgcaaccggacttcatgatcggcagttcggttaaatggctgtgctcgggccctggtgcggcatatctgtgggttaatccggcgattctgccggaatgtcagccgcaggatgtgggctggttttcacatgagaatccctttgaattcgacatccacgatttccgctaccacccgactgcactgcgcttttggggtggtacgccgtcgatcgcgccttatgcgatcgcggcgcactcgatcgaatattttgccaatatcggctcgcaagtgatgcgtgaacacaacctgcaactgatggaaccggtggttcaggcgctggacaatgaactggtgagcccgcaggaagtggataaacgctcaggcactattattctgcaattcggtgaacgtcaaccgcaaattctggcggctctggctgcggcgaacatttcggtggacactcgttctttggggattcgtgttagtccgcacatttataatgatgaggcggacattgcgcgcctgctgggtgtgatcaaagcaaatcgctaaaaataaaacgaaaggctcagtcgaaagactgggcctttcgttttatctgttg

SEQ ID NO: 95 - protein, 490 aa, Artificial Sequence
  Description of Artificial Sequence: Synthetic polypeptide
MSQVIKKKRNTFMIGTEYILNSTQLEEAIKSFVHDFCAEKHEIHDQPVVVEAKEHQEDKIKQIKIPEKGRPVNEVVSEMMNEVYRYRGDANHPRFFSFVPGPASSVSWLGDIMTSAYNIHAGGSKLAPMVNCIEQEVLKWLAKQVGFTENPGGVFVSGGSMANITALTAARDNKLTDINLHLGTAYISDQTHSSVAKGLRIIGITDSRIRRIPTNSHFQMDTTKLEEAIETDKKSGYIPFVVIGTAGTTNTGSIDPLTEISALCKKHDMWFHIDGAYGASVLLSPKYKSLLTGTGLADSISWDAHKWLFQTYGCAMVLVKDIRNLFHSFHVNPEYLKDLENDIDNVNTWDIGMELTRPARGLKLWLTLQVLGSDLIGSAIEHGFQLAVWAEEALNPKKDWEIVSPAQMAMINFRYAPKDLTKEEQDILNEKISHRILESGYAAIFTTVLNGKTVLRICAIHPEATQEDMQHTIDLLDQYGREIYTEMKKA

SEQ ID NO: 96 - DNA, 1470 bp, Artificial Sequence
  Description of Artificial Sequence: Synthetic polynucleotide
atgagtcaagtgattaagaagaaacgtaacacctttatgatcggaacggagtacattcttaacagtacacaattggaggaagcgattaaatcattcgtacatgatttctgcgcagagaagcatgagatccatgatcaacctgtggtagtagaagctaaagaacatcaggaggacaaaatcaaacaaatcaaaatcccggaaaagggacgtcctgtaaatgaagtcgtttctgagatgatgaatgaagtgtatcgctaccgcggagacgccaaccatcctcgctttttttcttttgtgcccggacctgcaagcagtgtgtcgtggttgggggatattatgacgtccgcctacaatattcatgctggaggctcaaagctggcaccgatggttaactgcattgagcaggaagttctgaagtggttagcaaagcaagtggggttcacagaaaatccaggtggcgtatttgtgtcgggcggttcaatggcgaatattacggcacttactgcggctcgtgacaataaactgaccgacattaaccttcatttgggaactgcttatattagtgaccagactcatagttcagttgcgaaaggattacgcattattggaatcactgacagtcgcatccgtcgcattcccactaactcccacttccagatggataccaccaagctggaggaagccatcgagaccgacaagaagtctggctacattccgttcgtcgttatcggaacagcaggtaccaccaacactggttcgattgaccccctgacagaaatctctgcgttatgtaagaagcatgacatgtggtttcatatcgacggagcgtatggagctagtgttctgctgtcacctaagtacaagagccttcttaccggaaccggcttggctgacagtatttcgtgggatgctcataaatggttgttccaaacgtacggctgtgcaatggtacttgtcaaagatatccgtaatttattccactcttttcatgtgaatcccgagtatcttaaggatctggaaaacgacatcgataacgttaatacatgggacatcggcatggagctgacgcgccctgcacgcggtcttaaattgtggcttactttacaggtccttggatctgacttgattgggagtgccattgaacacggtttccagctggcagtttgggctgaggaagcattgaatccaaagaaagactgggagatcgtttctccagctcagatggctatgattaatttccgttatgcccctaaggatttaaccaaagaggaacaggatattctgaatgaaaagatctcccaccgcattttagagagcggatacgctgcaattttcactactgtattaaacggcaagaccgttttacgcatctgtgcaattcacccggaggcaactcaagaggatatgcaacacacaatcgacttattagaccaatacggtcgtgaaatctataccgagatgaagaaagcg

SEQ ID NO: 97 - protein, 444 aa, Artificial Sequence
  Description of Artificial Sequence: Synthetic polypeptide
MTATTISIETVPQAPAAGTKTNGTSGKYNPRTYLSDRAKVTEIDGSDAGRPNPDTFPFNSITLNLKPPLGLPESSNNMPVSITIEDPDLATALQYAPSAGIPKLREWLADLQAHVHERPRGDYAISVGSGSQDLMFKGFQAVLNPGDPVLLETPMYSGVLPALRILKADYAEVDVDDQGLSAKNLEKVLSEWPADKKRPRVLYTSPIGSNPSGCSASKERKLEVLKVCKKYDVLIFEDDPYYYLAQELIPSYFALEKQVYPEGGHVVRFDSFSKLLSAGMRLGFATGPKEILHAIDVSTAGANLHTSAVSQGVALRLMQYWGIEGFLAHGRAVAKLYTERRAQFEATAHKYLDGLATWVSPVAGMFLWIDLRPAGIEDSYELIRHEALAKGVLGVPGMAFYPTGRKSSHVRVSFSIVDLEDESDLGFQRLAEAIKDKRKALGLA

SEQ ID NO: 98 - DNA, 1332 bp, Artificial Sequence
  Description of Artificial Sequence: Synthetic polynucleotide
atgacggcaactacaatttctattgagaccgtacctcaggccccggcggcggggaccaaaactaatgggacttcaggaaaatacaacccccgcacttacctgtccgaccgcgccaaagtcactgagattgatggatctgacgccggtcgccccaatcccgatactttcccatttaactcgattaccttaaatttgaaaccacctttaggcttgcccgagagttcaaataacatgccggtctctatcacgattgaagaccccgatttagcgacggccttacaatatgcacctagcgccggtattcctaagctgcgcgaatggctggctgacttacaagctcacgttcatgagcgcccccgtggcgattatgccatctcggtcgggtcggggtcacaggatttgatgtttaagggcttccaagctgtcttgaatccaggtgatccagtccttctggaaaccccaatgtattcaggtgttctgccagcgctgcgcattctgaaggcggattatgcagaagttgatgtagacgaccaggggttatctgctaaaaaccttgaaaaagttttatcagagtggcccgcagataagaagcgtcctcgtgtcctgtatacgtcgccaatcggctccaatccttccggatgttcagcatccaaggaacgcaagttagaggtactgaaagtctgtaagaagtacgatgtgctgatcttcgaagacgatccgtattattaccttgctcaagagcttattccatcctattttgcgttggaaaaacaagtttatccggagggtgggcacgttgtacgctttgactcatttagtaaattgctttctgctgggatgcgcttgggatttgctacagggccgaaggaaattcttcatgcgattgacgtcagtacagcaggcgcaaatttacatacttcagcggtctctcaaggtgtcgctcttcgcctgatgcagtattgggggatcgagggattccttgcacatggccgcgcggtggccaaactttacacggagcgccgcgctcagttcgaggcaaccgcacataagtacctggacgggctggccacttgggtatctcccgtagcgggaatgtttttatggatcgatcttcgtccagcaggaatcgaagattcttacgaattaattcgccatgaagcattagccaaaggcgttttaggcgttccagggatggcgttttatccgacaggccgtaagtcttcccatgttcgtgtcagtttcagtatcgtcgacctggaagacgaatctgaccttggttttcaacgcctggctgaagctattaaggataaacgcaaggctttagggctggct

SEQ ID NO: 99 - protein, 500 aa, Artificial Sequence
  Description of Artificial Sequence: Synthetic polypeptide
MGSIDSTNVAMSNSPVGEFKPLEAEEFRKQAHRMVDFIADYYKNVETYPVLSEVEPGYLRKRIPETAPYLPEPLDDIMKDIQKDIIPGMTNWMSPNFYAFFPATVSSAAFLGEMLSTALNSVGFTWVSSPAATELEMIVMDWLAQILKLPKSFMFSGTGGGVIQNTTSESILCTIIAARERALEKLGPDSIGKLVCYGSDQTHTMFPKTCKLAGIYPNNIRLIPTTVETDFGISPQVLRKMVEDDVAAGYVPLFLCATLGTTSTTATDPVDSLSEIANEFGIWIHVDAAYAGSACICPEFRHYLDGIERVDSLSLSPHKWLLAYLDCTCLWVKQPHLLLRALTTNPEYLKNKQSDLDKVVDFKNWQIATGRKFRSLKLWLILRSYGVVNLQSHIRSDVAMGKMFEEWVRSDSRFEIVVPRNFSLVCFRLKPDVSSLHVEEVNKKLLDMLNSTGRVYMTHTIVGGIYMLRLAVGSSLTEEHHVRRVWDLIQKLTDDLLKEA

SEQ ID NO: 100 - protein, 757 aa, Artificial Sequence
  Description of Artificial Sequence: Synthetic polypeptide
MGSPSLYSARKTTLALAVALSFAWQAPVFAHGGEAHMVPMDKTLKEFGADVQWDDYAQLFTLIKDGAYVKVKPGAQTAIVNGQPLALQVPVVMKDNKAWVSDTFINDVFQSGLDQTFQVEKRPHPLNALTADEIKQAVEIVKASADFKPNTRFTEISLLPPDKEAVWAFALENKPVDQPRKADVIMLDGKHIIEAVVDLQNNKLLSWQPIKDAHGMVLLDDFASVQNIINNSEEFAAAVKKRGITDAKKVITTPLTVGYFDGKDGLKQDARLLKVISYLDVGDGNYWAHPIENLVAVVDLEQKKIVKIEEGPVVPVPMTARPFDGRDRVAPAVKPMQIIEPEGKNYTITGDMIHWRNWDFHLSMNSRVGPMISTVTYNDNGTKRKVMYEGSLGGMIVPYGDPDIGWYFKAYLDSGDYGMGTLTSPIARGKDAPSNAVLLNETIADYTGVPMEIPRAIAVFERYAGPEYKHQEMGQPNVSTERRELVVRWISTVGNYDYIFDWIFHENGTIGIDAGATGIEAVKGVKAKTMHDETAKDDTRYGTLIDHNIVGTTHQHIYNFRLDLDVDGENNSLVAMDPVVKPNTAGGPRTSTMQVNQYNIGNEQDAAQKFDPGTIRLLSNPNKENRMGNPVSYQIIPYAGGTHPVAKGAQFAPDEWIYHRLSFMDKQLWVTRYHPGERFPEGKYPNRSTHDTGLGQYSKDNESLDNTDAVVWMTTGTTHVARAEEWPIMPTEWVHTLLKPWNFFDETPTLGALKKDK

SEQ ID NO: 101 - protein, 1368 aa, Artificial Sequence
  Description of Artificial Sequence: Synthetic polypeptide
MGEKAIDEDKVEAMKSSKTSLVFAINGQRFELELSSIDPSTTLVDFLRNKTPFKSVKLGCGEGGCGACVVLLSKYDPLLEKVDEFTISSCLTLLCSIDGCSITTSDGLGNSRVGFHAVHERIAGFHATQCGFCTPGMSVSMFSALLNADKSHPPPRSGFSNLTAVEAEKAVSGNLCRCTGYRPLVDACKSFAADVDIEDLGFNAFCKKGENRDEVLRRLPCYDHTSSHVCTFPEFLKKEIKNDMSLHSRKYRWSSPVSVSELQGLLEVENGLSVKLVAGNTSTGYYKEEKERKYERFIDIRKIPEFTMVRSDEKGVELGACVTISKAIEVLREEKNVSVLAKIATHMEKIANRFVRNTGTIGGNIMMAQRKQFPSDLATILVAAQATVKIMTSSSSQEQFTLEEFLQQPPLDAKSLLLSLEIPSWHSAKKNGSSEDSILLFETYRAAPRPLGNALAFLNAAFSAEVTEALDGIVVNDCQLVFGAYGTKHAHRAKKVEEFLTGKVISDEVLMEAISLLKDEIVPDKGTSNPGYRSSLAVTFLFEFFGSLTKKNAKTTNGWLNGGCKEIGFDQNVESLKPEAMLSSAQQIVENQEHSPVGKGITKAGACLQASGEAVYVDDIPAPENCLYGAFIYSTMPLARIKGIRFKQNRVPEGVLGIITYKDIPKGGQNIGTNGFFTSDLLFAEEVTHCAGQIIAFLVADSQKHADIAANLVVIDYDTKDLKPPILSLEEAVENFSLFEVPPPLRGYPVGDITKGMDEAEHKILGSKISFGSQYFFYMETQTALAVPDEDNCMVVYSSTQTPEFVHQTIAGCLGVPENNVRVITRRVGGGFGGKAVKSMPVAAACALAASKMQRPVRTYVNRKTDMITTGGRHPMKVTYSVGFKSNGKITALDVEVLLDAGLTEDISPLMPKGIQGALMKYDWGALSFNVKVCKTNTVSRTALRAPGDVQGSYIGEAIIEKVASYLSVDVDEIRKVNLHTYESLRLFHSAKAGEFSEYTLPLLWDRIDEFSGFNKRRKVVEEFNASNKWRKRGISRVPAVYAVNMRSTPGRVSVLGDGSIVVEVQGIEIGQGLWTKVKQMAAYSLGLIQCGTTSDELLKKIRVIQSDTLSMVQGSMTAGSTTSEASSEAVRICCDGLVERLLPVKTALVEQTGGPVTWDSLISQAYQQSINMSVSSKYMPDSTGEYLNYGIAASEVEVNVLTGETTILRTDIIYDCGKSLNPAVDLGQIEGAFVQGLGFFMLEEFLMNSDGLVVTDSTWTYKIPTVDTIPRQFNVEILNSGQHKNRVLSSKASGEPPLLLAASVHCAVRAAVKEARKQILSWNSNKQGTDMYFELPVPATMPIVKEFCGLDVVEKYLEWKIQQRKNV

SEQ ID NO: 102 - protein, 513 aa, Artificial Sequence
  Description of Artificial Sequence: Synthetic polypeptide
MTAGSAPPVDYTSLKKNFQPFLSRRVENRSLKSFWDASDISDDVIELAGGMPNERFFPIESMDLKISKVPFNDNPKWHNSFTTAHLDLGSPSELPIARSFQYAETKGLPPLLHFVKDFVSRINRPAFSDETESNWDVILSGGSNDSMFKVFETICDESTTVMIEEFTFTPAMSNVEATGAKVIPIKMNLTFDRESQGIDVEYLTQLLDNWSTGPYKDLNKPRVLYTIATGQNPTGMSVPQWKREKIYQLAQRHDFLIVEDDPYGYLYFPSYNPQEPLENPYHSSDLTTERYLNDFLMKSFLTLDTDARVIRLETFSKIFAPGLRLSFIVANKFLLQKILDLADITTRAPSGTSQAIVYSTIKAMAESNLSSSLSMKEAMFEGWIRWIMQIASKYNHRKNLTLKALYETESYQAGQFTVMEPSAGMFIIIKINWGNFDRPDDLPQQMDILDKFLLKNGVKVVLGYKMAVCPNYSKQNSDFLRLTIAYARDDDQLIEASKRIGSGIKEFFDNYKS

SEQ ID NO: 103 - protein, 396 aa, Artificial Sequence
  Description of Artificial Sequence: Synthetic polypeptide
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 104 - protein, 391 aa, Artificial Sequence
  Description of Artificial Sequence: Synthetic polypeptide
MVKLENSRKPEKISNKNIPMSDFVVNLDHGDPTAYEEYWRKMGDRCTVTIRGCDLMSYFSDMTNLCWFLEPELEDAIKDLHGVVGNAATEDRYIVVGTGSTQLCQAAVHALSSLARSQPVSVVAAAPFYSTYVEETTYVRSGMYKWEGDAWGFDKKGPYIELVTSPNNPDGTIRETVVNRPDDDEAKVIHDFAYYWPHYTPITRRQDHDIMLFTFSKITGHAGSRIGWALVKDKEVAKKMVEYIIVNSIGVSKESQVRTAKILNVLKETCKSESESENFFKYGREMMKNRWEKLREVVKESDAFTLPKYPEAFCNYFGKSLESYPAFAWLGTKEETDLVSELRRHKVMSRAGERCGSDKKHVRVSMLSREDVFNVFLERLANMKLIKSIDL

SEQ ID NO: 105 - protein, 504 aa, Artificial Sequence
  Description of Artificial Sequence: Synthetic polypeptide
MTAPLQDSDGPDDAIGGPKQVTVIGAGIAGLVTAYELERLGHHVQIIEGSDDIGGRIHTHRFSGAGGPGPFAEMGAMRIPAGHRLTMHYIAELGLQNQVREFRTLFSDDAAYLPSSAGYLRVREAHDTLVDEFATGLPSAHYRQDTLLFGAWLDASIRAIAPRQFYDGLHNDIGVELLNLVDDIDLTPYRCGTARNRIDLHALFADHPRVRASCPPRLERFLDDVLDETSSSIVRLKDGMDELPRRLASRIRGKISLGQEVTGIDVHDDTVTLTVRQGLRTVTRTCDYVVCTIPFTVLRTLRLTGFDQDKLDIVHETKYWPATKIAFHCREPFWEKDGISGGASFTGGHVRQTYYPPAEGDPALGAVLLASYTIGPDAEALARMDEAERDALVAKELSVMHPELRRPGMVLAVAGRDWGARRWSRGAATVRWGQEAALREAERRECARPQKGLFFAGEHCSSKPAWIEGAIESAIDAAHEIEWYEPRASRVFAASRLSRSDRSA

SEQ ID NO: 106 - protein, 552 aa, Artificial Sequence
  Description of Artificial Sequence: Synthetic polypeptide
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQAHADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELCKQHVHAGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEACNNA

SEQ ID NO: 107 - protein, 497 aa, Artificial Sequence
  Description of Artificial Sequence: Synthetic polypeptide
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 108 - protein, 415 aa, Artificial Sequence
  Description of Artificial Sequence: Synthetic polypeptide
MEFVTETLGKRIHDPYVEETRCLMIPGPIIVGSGPSGLATAACLKSRDIPSLILERSTCIASLWQHKTYDRLRLHLPKDFCELPLMPFPSSYPTYPTKQQFVQYLESYAEHFDLKPVFNQTVEEAKFDRRCGLWRVRTTGGKKDETMEYVSRWLVVATGENAEEVMPEIDGIPDFGGPILHTSSYKSGEIFSEKKILVVGCGNSGMEVCLDLCNFNALPSLVVRDSVHVLPQEMLGISTFGISTSLLKWFPVHVVDRFLLRMSRLVLGDTDRLGLVRPKLGPLERKIKCGKTPVLDVGTLAKIRSGHIKVYPELKRVMHYSAEFVDGRVDNFDAIILATGYKSNVPMWLKGVNMFSEKDGFPHKPFPNGWKGESGLYAVGFTKLGLLGAAIDAKKIAEDIEVQRHFLPLARPQHC

SEQ ID NO: 109 - protein, 557 aa, Artificial Sequence
  Description of Artificial Sequence: Synthetic polypeptide
MYDHFNSPSIDILYDYGPFLKKCEMTGGIGSYSAGTPTPRVAIVGAGISGLVAATELLRAGVKDVVLYESRDRIGGRVWSQVFDQTRPRYIAEMGAMRFPPSATGLFHYLKKFGISTSTTFPDPGVVDTELHYRGKRYHWPAGKKPPELFRRVYEGWQSLLSEGYLLEGGSLVAPLDITAMLKSGRLEEAAIAWQGWLNVFRDCSFYNAIVCIFTGRHPPGGDRWARPEDFELFGSLGIGSGGFLPVFQAGFTEILRMVINGYQSDQRLIPDGISSLAARLADQSFDGKALRDRVCFSRVGRISREAEKIIIQTEAGEQRVFDRVIVTSSNRAMQMIHCLTDSESFLSRDVARAVRETHLTGSSKLFILTRTKFWIKNKLPTTIQSDGLVRGVYCLDYQPDEPEGHGVVLLSYTWEDDAQKMLAMPDKKTRCQVLVDDLAAIHPTFASYLLPVDGDYERYVLHHDWLTDPHSAGAFKLNYPGEDVYSQRLFFQPMTANSPNKDTGLYLAGCSCSFAGGWIEGAVQTALNSACAVLRSTGGQLSKGNPLDCINASYRY

SEQ ID NO: 110 - protein, 455 aa, Artificial Sequence
  Description of Artificial Sequence: Synthetic polypeptide
MHEIITLESLCQALADGEIAAAELRERALDTEARLARLNCFIREGDAVSQFGEADHAMKGTPLWGMPVSFKDNICVRGLPLTAGTRGMSGFVSDQDAAIVSQLRALGAVVAGKNNMHELSFGVTSINPHWGTVGNPVAPGYCAGGSSGGSAAAVASGIVPLSVGTDTGGSIRIPAAFCGITGFRPTTGRWSTAGIIPVSHTKDCVGLLTRTAGDAGFLYGLLSGKQQSFPLSRTAPCRIGLPVSMWSDLDGEVERACVNALSLLRKTGFEFIEIDDADIVELNQTLTFTVPLYEFFADLAQSLLSLGWKHGIHHIFAQVDDANVKGIINHHLGEGAIKPAHYLSSLQNGELLKRKMDELFARHNIELLGYPTVPCRVPHLDHADRPEFFSQAIRNTDLASNAMLPSITIPVGPEGRLPVGLSFDALRGRDALLLSRVSAIEQVLGFVRKVLPHTT

SEQ ID NO: 111 - protein, 353 aa, Artificial Sequence
  Description of Artificial Sequence: Synthetic polypeptide
MLLFETVREMGHEQVLFCHSKNPEIKAIIAIHDTTLGPAMGATRILPYINEEAALKDALRLSRGMTYKAACANIPAGGGKAVIIANPENKTDDLLRAYGRFVDSLNGRFITGQDVNITPDDVRTISQETKYVVGVSEKSGGPAPITSLGVFLGIKAAVESRWQSKRLDGMKVAVQGLGNVGKNLCRHLHEHDVQLFVSDVDPIKAEEVKRLFGATVVEPTEIYSLDVDIFAPCALGGILNSHTIPFLQASIIAGAANNQLENEQLHSQMLAKKGILYSPDYVINAGGLINVYNEMIGYDEEKAFKQVHNIYDTLLAIFEIAKEQGVTTNDAARRLAEDRINNSKRSKSKAIAA

SEQ ID NO: 112 - protein, 541 aa, Artificial Sequence
  Description of Artificial Sequence: Synthetic polypeptide
MNTFTSNSSDLTTTATETSSFSTLYLLSTLQAFVAITLVMLLKKLMTDPNKKKPYLPPGPTGWPIIGMIPTMLKSRPVFRWLHSIMKQLNTEIACVKLGNTHVITVTCPKIAREILKQQDALFASRPLTYAQKILSNGYKTCVITPFGDQFKKMRKVVMTELVCPARHRWLHQKRSEENDHLTAWVYNMVKNSGSVDFRFMTRHYCGNAIKKLMFGTRTFSKNTAPDGGPTVEDVEHMEAMFEALGFTFAFCISDYLPMLTGLDLNGHEKIMRESSAIMDKYHDPIIDERIKMWREGKRTQIEDFLDIFISIKDEQGNPLLTADEIKPTIKELVMAAPDNPSNAVEWAMAEMVNKPEILRKAMEEIDRVVGKERLVQESDIPKLNYVKAILREAFRLHPVAAFNLPHVALSDTTVAGYHIPKGSQVLLSRYGLGRNPKVWADPLCFKPERHLNECSEVTLTENDLRFISFSTGKRGCAAPALGTALTTMMLARLLQGFTWKLPENETRVELMESSHDMFLAKPLVMVGDLRLPEHLYPTVK

SEQ ID NO: 113 - protein, 543 aa, Artificial Sequence
  Description of Artificial Sequence: Synthetic polypeptide
MDTLASNSSDLTTKSSLGMSSFTNMYLLTTLQALAALCFLMILNKIKSSSRNKKLHPLPPGPTGFPIVGMIPAMLKNRPVFRWLHSLMKELNTEIACVRLGNTHVIPVTCPKIAREIFKQQDALFASRPLTYAQKILSNGYKTCVITPFGEQFKKMRKVIMTEIVCPARHRWLHDNRAEETDHLTAWLYNMVKNSEPVDLRFVTRHYCGNAIKRLMFGTRTFSEKTEADGGPTLEDIEHMDAMFEGLGFTFAFCISDYLPMLTGLDLNGHEKIMRESSAIMDKYHDPIIDERIKMWREGKRTQIEDFLDIFISIKDEAGQPLLTADEIKPTIKELVMAAPDNPSNAVEWAIAEMINKPEILHKAMEEIDRVVGKERFVQESDIPKLNYVKAIIREAFRLHPVAAFNLPHVALSDTTVAGYHIPKGSQVLLSRYGLGRNPKVWSDPLSFKPERHLNECSEVTLTENDLRFISFSTGKRGCAAPALGTAITTMMLARLLQGFKWKLAGSETRVELMESSHDMFLSKPLVLVGELRLSEDLYPMVK

SEQ ID NO: 114 - protein, 503 aa, Artificial Sequence
  Description of Artificial Sequence: Synthetic polypeptide
MSNIQEMEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 115 - protein, 560 aa, Artificial Sequence
  Description of Artificial Sequence: Synthetic polypeptide
MAHLQRTFPTEMSKGRASFPKGFLFGTASSSYQYEGAVNEGARGQSVWDHFSNRFPHRISDSSDGNVAVDFYHRYKEDIKRMKDINMDSFRLSIAWPRVLPYGKRDRGVSEEGIKFYNDVIDELLANEITPLVTIFHWDIPQDLEDEYGGFLSEQIIDDFRDYASLCFERFGDRVSLWCTMNEPWVYSVAGYDTGRKAPGRCSKYVNGASVAGMSGYEAYIVSHNMLLAHAEAVEVFRKCDHIKNGQIGIAHNPLWYEPYDPSDPDDVEGCNRAMDFMLGWHQHPTACGDYPETMKKSVGDRLPSFTPEQSKKLIGSCDYVGINYYSSLFVKSIKHVDPTQPTWRTDQGVDWMKTNIDGKQIAKQGGSEWSFTYPTGLRNILKYVKKTYGNPPILITENGYGEVAEQSQSLYMYNPSIDTERLEYIEGHIHAIHQAIHEDGVRVEGYYVWSLLDNFEWNSGYGVRYGLYYIDYKDGLRRYPKMSALWLKEFLRFDQEDDSSTSKKEEKKESYGKQLLHSVQDSQFVHSIKDSGALPAVLGSLFVVSATVGTSLFFKGANN

SEQ ID NO: 116 - protein, 346 aa, Artificial Sequence
  Description of Artificial Sequence: Synthetic polypeptide
MSSTKDMSTVQNATPFNGVAPSTTVRVTIVQSSTVYNDTPATIDKAEKYIVEAASKGAELVLFPEGFIGGYPRGFRFGLAVGVHNEEGRDEFRKYHASAIHVPGPEVARLADVARKNHVYLVMGAIEKEGYTLYCTVLFFSPQGQFLGKHRKLMPTSLERCIWGQGDGSTIPVYDTPIGKLGAAICWENRMPLYRTALYAKGIELYCAPTADGSKEWQSSMLHIAIEGGCFVLSACQFCQRKHFPDHPDYLFTDWYDDKEHDSIVSQGGSVIISPLGQVLAGPNFESEGLVTADIDLGDIARAKLYFDSVGHYSRPDVLHLTVNEHPRKSVTFVTKVEKAEDDSNK

SEQ ID NO: 117 - protein, 403 aa, Artificial Sequence [sequence omitted]

SEQ ID NO: 118 - protein, 406 aa, Artificial Sequence
  Description of Artificial Sequence: Synthetic polypeptide
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 119 - protein, 453 aa, Artificial Sequence
  Description of Artificial Sequence: Synthetic polypeptide
MNNTSITGPQVLHRTKMRPLPVLEKYCISPHHGFLDDRLPLTRLSSKKYMKWEEIVADLPSLLQEDNKVRSVIDGLDVLDLDETILGDVRELRRAYSILGFMAHAYIWASGTPRDVLPECIARPLLETAHILGVPPLATYSSLVLWNFKVTDECKKTETGCLDLENITTINTFTGTVDESWFYLVSVRFEKIGSACLNHGLQILRAIRSGDKGDANVIDGLEGLAATIERLSKALMEMELKCEPNVFYFKIRPFLAGWTNMSHMGLPQGVRYGAEGQYRIFSGGSNAQSSLIQTLDILLGVKHTANAAHSSQGDSKINYLDEMKKYMPREHREFLYHLESVCNIREYVSRNASNRALQEAYGRCISMLKIFRDNHIQIVTKYIILPSNSKQHGSNKPNVLSPIEPNTKASGCLGHKVASSKTIGTGGTRLMPFLKQCRDETVATADIKNEDKN

SEQ ID NO: 120 - protein, 305 aa, Artificial Sequence
  Description of Artificial Sequence: Synthetic polypeptide
MAFPSLSAGQNPWRNLSSEELEKQYSPSRWVIHTKPEEVVGNFVQIGSQATQKARATRRNQLDVPYGDGEGEKLDIYFPDEDSKAFPLFLFLHGGYWQSGSKDDSAFMVNPLTAQGIVVVIVAYDIAPKGTLDQMVDQVTRSVVFLQRRYPSNEGIYLCGHSAGAHLAAMVLLARWTKHGVTPNLQGFLLVSGIYDLEPLIATSQNDPLRMTLEDAQRNSPQRHLDVVPAQPVAPACPVLVLVGQHDSPEFHRQSKEFYETLLRVGWKASFQQLRGVDHFDIIENLTREDDVLTQIILKTVFQKL

SEQ ID NO: 121 - protein, 444 aa, Artificial Sequence
  Description of Artificial Sequence: Synthetic polypeptide
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 122 - protein, 430 aa, Artificial Sequence
  Description of Artificial Sequence: Synthetic polypeptide
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 123 - protein, 425 aa, Artificial Sequence
  Description of Artificial Sequence: Synthetic polypeptide
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 124 - protein, 422 aa, Artificial Sequence
  Description of Artificial Sequence: Synthetic polypeptide
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 125 - protein, 454 aa, Artificial Sequence
  Description of Artificial Sequence: Synthetic polypeptide
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 126 - protein, 471 aa, Artificial Sequence
  Description of Artificial Sequence: Synthetic polypeptide
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 127 - protein, 412 aa, Clostridium sporogenes
MENNTNMFSGVKVIELANFIAAPAAGRFFADGGAEVIKIESPAGDPLRYTAPSEGRPLSQEENTTYDLENANKKAIVLNLKSEKGKKILHEMLAEADILLTNWRTKALVKQGLDYETLKEKYPKLVFAQITGYGEKGPDKDLPGFDYTAFFARGGVSGTLYEKGTVPPNVVPGLGDHQAGMFLAAGMAGALYKAKTTGQGDKVTVSLMHSAMYGLGIMIQAAQYKDHGLVYPINRNETPNPFIVSYKSKDDYFVQVCMPPYDVFYDRFMTALGREDLVGDERYNKIENLKDGRAKEVYSIIEQQMVTKTKDEWDKIFRDADIPFAIAQTWEDLLEDEQAWANDYLYKMKYPTGNERALVRLPVFFKEAGLPEYNQSPQIAENTVEVLKEMGYTEQEIEELEKDKDIMVRKEK

SEQ ID NO: 128 - protein, 407 aa, Clostridium sporogenes
MSDRNKEVKEKKAKHYLREITAKHYKEALEAKERGEKVGWCASNFPQEIATTLGVKVVYPENHAAAVAARGNGQNMCEHAEAMGFSNDVCGYARVNLAVMDIGHSEDQPIPMPDFVLCCNNICNQMIKWYEHIAKTLDIPMILIDIPYNTENTVSQDRIKYIRAQFDDAIKQLEEITGKKWDENKFEEVMKISQESAKQWLRAASYAKYKPSPFSGFDLFNHMAVAVCARGTQEAADAFKMLADEYEENVKTGKSTYRGEEKQRILFEGIACWPYLRHKLTKLSEYGMNVTATVYAEAFGVIYENMDELMAAYNKVPNSISFENALKMRLNAVTSTNTEGAVIHINRSCKLWSGFLYELARRLEKETGIPVVSFDGDQADPRNFSEAQYDTRIQGLNEVMVAKKEAE

SEQ ID NO: 129 - protein, 374 aa, Clostridium sporogenes
MSNSDKFFNDFKDIVENPKKYIMKHMEQTGQKAIGCMPLYTPEELVLAAGMFPVGVWGSNTELSKAKTYFPAFICSILQTTLENALNGEYDMLSGMMITNYCDSLKCMGQNFKLTVENIEFIPVTVPQNRKMEAGKEFLKSQYKMNIEQLEKISGNKITDESLEKAIEIYDEHRKVMNDFSMLASKYPGIITPTKRNYVMKSAYYMDKKEHTEKVRQLMDEIKAIEPKPFEGKRVITTGIIADSEDLLKILEENNIAIVGDDIAHESRQYRTLTPEANTPMDRLAEQFANRECSTLYDPEKKRGQYIVEMAKERKADGIIFFMTKFCDPEEYDYPQMKKDFEEAGIPHVLIETDMQMKNYEQARTAIQAFSETL

SEQ ID NO: 130 - protein, 377 aa, Clostridium sporogenes
MFFTEQHELIRKLARDFAEQEIEPIADEVDKTAEFPKEIVKKMAQNGFFGIKMPKEYGGAGADNRAYVTIMEEISRASGVAGIYLSSPNSLLGTPFLLVGTDEQKEKYLKPMIRGEKTLAFALTEPGAGSDAGALATTAREEGDYYILNGRKTFITGAPISDNIIVFAKTDMSKGTKGITTFIVDSKQEGVSFGKPEDKMGMIGCPTSDIILENVKVHKSDILGEVNKGFITAMKTLSVGRIGVASQALGIAQAAVDEAVKYAKQRKQFNRPIAKFQAIQFKLANMETKLNAAKLLVYNAAYKMDCGEKADKEASMAKYFAAESAIQIVNDALQIHGGYGYIKDYKIERLYRDVRVIAIYEGTSEVQQMVIASNLLK

SEQ ID NO: 131 - protein, 331 aa, Clostridium sporogenes
MKILAYCVRPDEVDSFKKFSEKYGHTVDLIPDSFGPNVAHLAKGYDGISILGNDTCNREALEKIKDCGIKYLATRTAGVNNIDFDAAKEFGINVANVPAYSPNSVSEFTIGLALSLTRKIPFALKRVELNNFALGGLIGVELRNLTLGVIGTGRIGLKVIEGFSGFGMKKMIGYDIFENEEAKKYIEYKSLDEVFKEADIITLHAPLTDDNYHMIGKESIAKMKDGVFIINAARGALIDSEALIEGLKSGKIAGAALDSYEYEQGVFHNNKMNEIMQDDTLERLKSFPNVVITPHLGFYTDEAVSNMVEITLMNLQEFELKGTCKNQRVCK

SEQ ID NO: 132 - protein, 334 aa, Clostridium sporogenes
MKILMYSVREHEKPAIKKWLEANPGVQIDLCNNALSEDTVCKAKEYDGIAIQQTNSIGGKAVYSTLKEYGIKQIASRTAGVDMIDLKMASDSNILVTNVPAYSPNAIAELAVTHTMNLLRNIKTLNKRIAYGDYRWSADLIAREVRSVTVGVVGTGKIGRTSAKLFKGLGANVIGYDAYPDKKLEENNLLTYKESLEDLLREADVVTLHTPLLESTKYMINKNNLKYMKPDAFIVNTGRGGIINTEDLIEALEQNKIAGAALDTFENEGLFLNKVVDPTKLPDSQLDKLLKMDQVLITHHVGFFTTTAVQNIVDTSLDSVVEVLKTNNSVNKVN

SEQ ID NO: 133 - protein, 326 aa, Rhodobacter sphaeroides; identical to SEQ ID NO: 60

SEQ ID NO: 134 - DNA, 483 bp, Artificial Sequence
  Description of Artificial Sequence: Synthetic polynucleotide
atgagccccggacagggaactcaaagcgagaacagctgcacacattttccaggtaatcttccaaatatgcttcgtgacttgcgtgacgctttctctcgcgtgaaaaccttttttcagatgaaggatcagttagataatctgctgctgaaagaatcgcttcttgaggacttcaagggatatctgggatgtcaggcgttatctgagatgattcagttttatttggaagaagttatgccccaggctgagaatcaagaccctgacatcaaagcgcatgtgaatagcctgggcgagaatctgaagacactgcgcctgcgtcttcgccgctgtcaccgttttctgccttgcgaaaataagagtaaggccgttgagcaagtgaaaaatgctttcaacaagttacaagaaaaagggatttacaaagctatgtctgagtttgacattttcattaattacattgaggcctacatgactatgaagattcgcaat

SEQ ID NO: 135 - protein, 134 aa, Artificial Sequence
  Description of Artificial Sequence: Synthetic polypeptide
MAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 136 - protein, 179 aa, Artificial Sequence
  Description of Artificial Sequence: Synthetic polypeptide
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 137 - protein, 243 aa, Artificial Sequence
  Description of Artificial Sequence: Synthetic polypeptide
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 138 - protein, 154 aa, Artificial Sequence [sequence omitted]

SEQ ID NO: 139 - protein, 33 aa, Artificial Sequence
  Description of Artificial Sequence: Synthetic polypeptide
HADGSFSDEMNTILDNLAARDFINWLIQTKITD

SEQ ID NO: 140 - protein, 33 aa, Artificial Sequence
  Description of Artificial Sequence: Synthetic polypeptide
HGDGSFSDEMNTILDNLAARDFINWLIQTKITD

SEQ ID NO: 141 - DNA, 290 bp, Artificial Sequence
  Description of Artificial Sequence: Synthetic polynucleotide
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaa

SEQ ID NO: 142 - DNA, 173 bp, Artificial Sequence
  Description of Artificial Sequence: Synthetic polynucleotide
atttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacct

SEQ ID NO: 143 - DNA, 305 bp, Artificial Sequence
  Description of Artificial Sequence: Synthetic polynucleotide
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggatccctctagaaataattttgtttaactttaagaaggagatatacat

SEQ ID NO: 144 - DNA, 180 bp, Artificial Sequence
  Description of Artificial Sequence: Synthetic polynucleotide
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacat

SEQ ID NO: 145 - DNA, 199 bp, Artificial Sequence
  Description of Artificial Sequence: Synthetic polynucleotide
agttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccctctagaaataattttgtttaactttaagaaggagatatacat

SEQ ID NO: 146 - DNA, 117 bp, Artificial Sequence
  Description of Artificial Sequence: Synthetic polynucleotide
atccccatcactcttgatggagatcaattccccaagctgctagagcgttaccttgcccttaaacattagcaatgtcgatttatcagagggccgacaggctcccacaggagaaaaccg

SEQ ID NO: 147 - DNA, 108 bp, Artificial Sequence
  Description of Artificial Sequence: Synthetic polynucleotide
ctcttgatcgttatcaattcccacgctgtttcagagcgttaccttgcccttaaacattagcaatgtcgatttatcagagggccgacaggctcccacaggagaaaaccg

SEQ ID NO: 148 - DNA, 290 bp, Artificial Sequence; identical to SEQ ID NO: 141
  Description of Artificial Sequence: Synthetic polynucleotide

SEQ ID NO: 149 - DNA, 433 bp, Artificial Sequence
  Description of Artificial Sequence: Synthetic polynucleotide
cggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgtttgtttaactttaagaaggagatatacat

SEQ ID NO: 150 - DNA, 290 bp, Artificial Sequence
  Description of Artificial Sequence: Synthetic polynucleotide
gtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaa

SEQ ID NO: 151 - DNA, 173 bp, Artificial Sequence; identical to SEQ ID NO: 142
  Description of Artificial Sequence: Synthetic polynucleotide

SEQ ID NO: 152 - DNA, 305 bp, Artificial Sequence; identical to SEQ ID NO: 143
  Description of Artificial Sequence: Synthetic polynucleotide

SEQ ID NO: 153 - DNA, 180 bp, Artificial Sequence; identical to SEQ ID NO: 144
  Description of Artificial Sequence: Synthetic polynucleotide

SEQ ID NO: 154 - DNA, 199 bp, Artificial Sequence; identical to SEQ ID NO: 145
  Description of Artificial Sequence: Synthetic polynucleotide

SEQ ID NO: 155 - DNA, 207 bp, Artificial Sequence
  Description of Artificial Sequence: Synthetic polynucleotide
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacat

SEQ ID NO: 156 - DNA, 390 bp, Artificial Sequence
  Description of Artificial Sequence: Synthetic polynucleotide
tcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtagaaatgtgatctagttcacatttgcggtaatagaaaagaaatcgaggcaaaaatgtttgtttaactttaagaaggagatatacat

SEQ ID NO: 157 - DNA, 200 bp, Artificial Sequence
  Description of Artificial Sequence: Synthetic polynucleotide
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcaaatgtgatctagttcacattttttgtttaactttaagaaggagatatacat

SEQ ID NO: 158 - DNA, 355 bp, Artificial Sequence
  Description of Artificial Sequence: Synthetic polynucleotide
tgtggcttttatgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgcgaattcattaaagaggagaaaggtacc

SEQ ID NO: 159 - DNA, 228 bp, Artificial Sequence
  Description of Artificial Sequence: Synthetic polynucleotide
ttccgaaaattcctggcgagcagataaataagaattgttcttatcaatatatctaactcattgaatctttattagttttgtttttcacgcttgttaccactattagtgtgataggaacagccagaatagcggaacacatagccggtgctatacttaatctcgttaattactgggacataacatcaagaggatatgaaattcgaattcattaaagaggagaaaggtacc

SEQ ID NO: 160 - DNA, 334 bp, Artificial Sequence
  Description of Artificial Sequence: Synthetic polynucleotide
gcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgcgaattcattaaagaggagaaaggtacc

SEQ ID NO: 161 - DNA, 134 bp, Artificial Sequence
  Description of Artificial Sequence: Synthetic polynucleotide
ctcgagttcattatccatcctccatcgccacgatagttcatggcgataggtagaatagcaatgaacgattatccctatcaagcattctgactgataattgctcacacgaattcattaaagaggagaaaggtacc

SEQ ID NO: 162 - DNA, 7878 bp, Artificial Sequence
  Description of Artificial Sequence: Synthetic polynucleotide
atggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 163 - DNA, 6090 bp, Artificial Sequence
  Description of Artificial Sequence: Synthetic polynucleotide
atgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 164 - DNA, 4947 bp, Artificial Sequence
  Description of Artificial Sequence: Synthetic polynucleotide
atgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 165 - DNA, 8575 bp, Artificial Sequence
  Description of Artificial Sequence: Synthetic polynucleotide
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 166 - DNA, 6787 bp, Artificial Sequence
  Description of Artificial Sequence: Synthetic polynucleotide
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 167 - DNA, 5644 bp, Artificial Sequence
  Description of Artificial Sequence: Synthetic polynucleotide
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 168 - DNA, 8012 bp, Artificial Sequence
  Description of Artificial Sequence: Synthetic polynucleotide
ctcgagttcattatccatcctccatcgccacgatagttcatggcgataggtagaatagcaatgaacgattatccctatcaagcattctgactgataattgctcacacgaattcattaaagaggagaaaggtaccatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 169 - DNA, 6224 bp, Artificial Sequence
  Description of Artificial Sequence: Synthetic polynucleotide
ctcgagttcattatccatcctccatcgccacgatagttcatggcgataggtagaatagcaatgaacgattatccctatcaagcattctgactgataattgctcacacgaattcattaaagaggagaaaggtaccatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 170 - DNA, 3118 bp, Artificial Sequence
  Description of Artificial Sequence: Synthetic polynucleotide
ctcgagatgctagcaattgtgagcggataacaattgacattgtgagcggataacaagatactgagcacatcagcaggacgcactgaccttaattaaaagaattcattaaagaggagaaaggtaccatgaatattcgtgatcttgagtacctggtggcattggctgaacaccgccattttcggcgtgcggcagattcctgccacgttagccagccgacgcttagcgggcaaattcgtaagctggaagatgagctgggcgtgatgttgctggagcggaccagccgtaaagtgttgttcacccaggcgggaatgctgctggtggatcaggcgcgtaccgtgctgcgtgaggtgaaagtccttaaagagatggcaagccagcagggcgagacgatgtccggaccgctgcacattggtttgattcccacagttggaccgtacctgctaccgcatattatccctatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagatcacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgccagcgctggctgtgccgccggagcgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagttttaaaacaggcggtttaaggatcccatggtacgcgtgctagaggcatcaaataaaacgaaaggctcagtcgaaagactgggcctttcgttttatctgttgtttgtcggtgaacgctctcctgagtaggacaaatccgccgccctagacctaggggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccgacgtctaagaaaccattattatcatgacattaacctataaaaataggcgtatcacgaggccctttcgtcttcac

SEQ ID NO: 171 - DNA, 5081 bp, Artificial Sequence
  Description of Artificial Sequence: Synthetic polynucleotide
ctcgagttcattatccatcctccatcgccacgatagttcatggcgataggtagaatagcaatgaacgattatccctatcaagcattctgactgataattgctcacacgaattcattaaagaggagaaaggtaccatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 172 - DNA, 8650 bp, Artificial Sequence
  Description of Artificial Sequence: Synthetic polynucleotide
gtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 173 - DNA, 6862 bp, Artificial Sequence
  Description of Artificial Sequence: Synthetic polynucleotide
gtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 174 - DNA, 5719 bp, Artificial Sequence
  Description of Artificial Sequence: Synthetic polynucleotide
gtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 175 - DNA, 180 bp, Artificial Sequence; identical to SEQ ID NO: 144
  Description of Artificial Sequence: Synthetic polynucleotide

SEQ ID NO: 176 - DNA, 8058 bp, Artificial Sequence
  Description of Artificial Sequence: Synthetic polynucleotide
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacatatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 177 - DNA, 6270 bp, Artificial Sequence
  Description of Artificial Sequence: Synthetic polynucleotide
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 178 - DNA, 5127 bp, Artificial Sequence
  Description of Artificial Sequence: Synthetic polynucleotide
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 179 - DNA, 5160 bp, Artificial Sequence
  Description of Artificial Sequence: Synthetic polynucleotide
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 180 - DNA, 6300 bp, Artificial Sequence
  Description of Artificial Sequence: Synthetic polynucleotide
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaa

SEQ ID NO: 181 - DNA, 213 bp, Artificial Sequence
  Description of Artificial Sequence: Synthetic polynucleotide
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacat

SEQ ID NO: 182 - DNA, 43 bp, Artificial Sequence
  Description of Artificial Sequence: Synthetic oligonucleotide
ctctagaaataattttgtttaactttaagaaggagatatacat

SEQ ID NO: 183 - DNA, 6939 bp, Artificial Sequence
  Description of Artificial Sequence: Synthetic polynucleotide
caaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtattcattaagcatctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcggaataggaactaaggaggatattcatatggaccatggctaattcccaggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaaaggaatttttatgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaatccctgcgaacgaaggagtaaaaatggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 184 - DNA, 5638 bp, Artificial Sequence
  Description of Artificial Sequence: Synthetic polynucleotide
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaaaggaatttttatgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaatccctgcgaacgaaggagtaaaaatggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 185 - DNA, 8698 bp, Artificial Sequence
  Description of Artificial Sequence: Synthetic polynucleotide
ttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcagatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagtaataagaaggagatatacatatggccttcaatagcgcagatattaattctttccgcgatatttgggtgttttgtgaacagcgtgagggcaaactgattaacaccgatttcgaattaattagcgaaggtcgtaaactggctgacgaacgcggaagcaaactggttggaattttgctggggcacgaagttgaagaaatcgcaaaagaattaggcggctatggtgcggacaaggtaattgtgtgcgatcatccggaacttaaattttacactacggatgcttatgccaaagttttatgtgacgtcgtgatggaagagaaaccggaggtaattttgatcggtgccaccaacattggccgtgatctcggaccgcgttgtgctgcacgcttgcacacggggctgacggctgattgcacgcacctggatattgatatgaataaatatgtggactttcttagcaccagtagcaccttggatatctcgtcgatgactttccctatggaagatacaaaccttaaaatgacgcgccctgcatttggcggacatctgatggcaacgatcatttgtccacgcttccgtccctgtatgagcacagtgcgccccggagtgatgaagaaagcggagttctcgcaggagatggcgcaagcatgtcaagtagtgacccgtcacgtaaatttgtcggatgaagaccttaaaactaaagtaattaatatcgtgaaggaaacgaaaaagattgtggatctgatcggcgcagaaattattgtgtcagttggtcgtggtatctcgaaagatgtccaaggtggaattgcactggctgaaaaacttgcggacgcatttggtaacggtgtcgtgggcggctcgcgcgcagtgattgattccggctggttacctgcggatcatcaggttggacaaaccggtaagaccgtgcacccgaaagtctacgtggcgctgggtattagtggggctatccagcataaggctgggatgcaagactctgaactgatcattgccgtcaacaaagacgaaacggcgcctatcttcgactgcgccgattatggcatcaccggtgatttatttaaaatcgtaccgatgatgatcgacgcgatcaaagagggtaaaaacgcatgataagaaggagatatacatatgcgcatctatgtgtgtgtgaaacaagtcccagatacgagcggcaaggtggccgttaaccctgatgggacccttaaccgtgcctcaatggcagcgattattaacccggacgatatgtccgcgatcgaacaggcattaaaactgaaagatgaaaccggatgccaggttacggcgcttacgatgggtcctcctcctgccgagggcatgttgcgcgaaattattgcaatgggggccgacgatggtgtgctgatttcggcccgtgaatttggggggtccgataccttcgcaaccagtcaaattattagcgcggcaatccataaattaggcttaagcaatgaagacatgatcttttgcggtcgtcaggccattgacggtgatacggcccaagtcggccctcaaattgccgaaaaactgagcatcccacaggtaacctatggcgcaggaatcaaaaaatctggtgatttagtgctggtgaagcgtatgttggaggatggttatatgatgatcgaagtcgaaactccatgtctgattacctgcattcaggataaagcggtaaaaccacgttacatgactctcaacggtattatggaatgctactccaagccgctcctcgttctcgattacgaagcactgaaagatgaaccgctgatcgaacttgataccattgggcttaaaggctccccgacgaatatctttaaatcgtttacgccgcctcagaaaggcgttggtgtcatgctccaaggcaccgataaggaaaaagtcgaggatctggtggataagctgatgcagaaacatgtcatctaataagaaggagatatacatatgttcttactgaagattaaaaaagaacgtatgaaacgcatggactttagtttaacgcgtgaacaggagatgttaaaaaaactggcgcgtcagtttgctgagatcgagctggaaccggtggccgaagagattgatcgtgagcacgtttttcctgcagaaaactttaagaagatggcggaaattggcttaaccggcattggtatcccgaaagaatttggtggctccggtggaggcaccctggagaaggtcattgccgtgtcagaattcggcaaaaagtgtatggcctcagcttccattttaagcattcatcttatcgcgccgcaggcaatctacaaatatgggaccaaagaacagaaagagacgtacctgccgcgtcttaccaaaggtggtgaactgggcgcctttgcgctgacagaaccaaacgccggaagcgatgccggcgcggtaaaaacgaccgcgattctggacagccagacaaacgagtacgtgctgaatggcaccaaatgctttatcagcgggggcgggcgcgcgggtgttcttgtaatttttgcgcttactgaaccgaaaaaaggtctgaaagggatgagcgcgattatcgtggagaaagggaccccgggcttcagcatcggcaaggtggagagcaagatggggatcgcaggttcggaaaccgcggaacttatcttcgaagattgtcgcgttccggctgccaaccttttaggtaaagaaggcaaaggctttaaaattgctatggaagccctggatggcgcccgtattggcgtgggcgctcaagcaatcggaattgccgagggggcgatcgacctgagtgtgaagtacgttcacgagcgcattcaatttggtaaaccgatcgcgaatctgcagggaattcaatggtatatcgcggatatggcgaccaaaaccgccgcggcacgcgcacttgttgagtttgcagcgtatcttgaagacgcgggtaaaccgttcacaaaggaatctgctatgtgcaagctgaacgcctccgaaaacgcgcgttttgtgacaaatttagctctgcagattcacgggggttacggttatatgaaagattatccgttagagcgtatgtatcgcgatgctaagattacggaaatttacgaggggacatcagaaatccataaggtggtgattgcgcgtgaagtaatgaaacgctaa

SEQ ID NO: 186 - DNA, 7950 bp, Artificial Sequence
  Description of Artificial Sequence: Synthetic polynucleotide
atgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcagatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagtaataagaaggagatatacatatggccttcaatagcgcagatattaattctttccgcgatatttgggtgttttgtgaacagcgtgagggcaaactgattaacaccgatttcgaattaattagcgaaggtcgtaaactggctgacgaacgcggaagcaaactggttggaattttgctggggcacgaagttgaagaaatcgcaaaagaattaggcggctatggtgcggacaaggtaattgtgtgcgatcatccggaacttaaattttacactacggatgcttatgccaaagttttatgtgacgtcgtgatggaagagaaaccggaggtaattttgatcggtgccaccaacattggccgtgatctcggaccgcgttgtgctgcacgcttgcacacggggctgacggctgattgcacgcacctggatattgatatgaataaatatgtggactttcttagcaccagtagcaccttggatatctcgtcgatgactttccctatggaagatacaaaccttaaaatgacgcgccctgcatttggcggacatctgatggcaacgatcatttgtccacgcttccgtccctgtatgagcacagtgcgccccggagtgatgaagaaagcggagttctcgcaggagatggcgcaagcatgtcaagtagtgacccgtcacgtaaatttgtcggatgaagaccttaaaactaaagtaattaatatcgtgaaggaaacgaaaaagattgtggatctgatcggcgcagaaattattgtgtcagttggtcgtggtatctcgaaagatgtccaaggtggaattgcactggctgaaaaacttgcggacgcatttggtaacggtgtcgtgggcggctcgcgcgcagtgattgattccggctggttacctgcggatcatcaggttggacaaaccggtaagaccgtgcacccgaaagtctacgtggcgctgggtattagtggggctatccagcataaggctgggatgcaagactctgaactgatcattgccgtcaacaaagacgaaacggcgcctatcttcgactgcgccgattatggcatcaccggtgatttatttaaaatcgtaccgatgatgatcgacgcgatcaaagagggtaaaaacgcatgataagaaggagatatacatatgcgcatctatgtgtgtgtgaaacaagtcccagatacgagcggcaaggtggccgttaaccctgatgggacccttaaccgtgcctcaatggcagcgattattaacccggacgatatgtccgcgatcgaacaggcattaaaactgaaagatgaaaccggatgccaggttacggcgcttacgatgggtcctcctcctgccgagggcatgttgcgcgaaattattgcaatgggggccgacgatggtgtgctgatttcggcccgtgaatttggggggtccgataccttcgcaaccagtcaaattattagcgcggcaatccataaattaggcttaagcaatgaagacatgatcttttgcggtcgtcaggccattgacggtgatacggcccaagtcggccctcaaattgccgaaaaactgagcatcccacaggtaacctatggcgcaggaatcaaaaaatctggtgatttagtgctggtgaagcgtatgttggaggatggttatatgatgatcgaagtcgaaactccatgtctgattacctgcattcaggataaagcggtaaaaccacgttacatgactctcaacggtattatggaatgctactccaagccgctcctcgttctcgattacgaagcactgaaagatgaaccgctgatcgaacttgataccattgggcttaaaggctccccgacgaatatctttaaatcgtttacgccgcctcagaaaggcgttggtgtcatgctccaaggcaccgataaggaaaaagtcgaggatctggtggataagctgatgcagaaacatgtcatctaataagaaggagatatacatatgttcttactgaagattaaaaaagaacgtatgaaacgcatggactttagtttaacgcgtgaacaggagatgttaaaaaaactggcgcgtcagtttgctgagatcgagctggaaccggtggccgaagagattgatcgtgagcacgtttttcctgcagaaaactttaagaagatggcggaaattggcttaaccggcattggtatcccgaaagaatttggtggctccggtggaggcaccctggagaaggtcattgccgtgtcagaattcggcaaaaagtgtatggcctcagcttccattttaagcattcatcttatcgcgccgcaggcaatctacaaatatgggaccaaagaacagaaagagacgtacctgccgcgtcttaccaaaggtggtgaactgggcgcctttgcgctgacagaaccaaacgccggaagcgatgccggcgcggtaaaaacgaccgcgattctggacagccagacaaacgagtacgtgctgaatggcaccaaatgctttatcagcgggggcgggcgcgcgggtgttcttgtaatttttgcgcttactgaaccgaaaaaaggtctgaaagggatgagcgcgattatcgtggagaaagggaccccgggcttcagcatcggcaaggtggagagcaagatggggatcgcaggttcggaaaccgcggaacttatcttcgaagattgtcgcgttccggctgccaaccttttaggtaaagaaggcaaaggctttaaaattgctatggaagccctggatggcgcccgtattggcgtgggcgctcaagcaatcggaattgccgagggggcgatcgacctgagtgtgaagtacgttcacgagcgcattcaatttggtaaaccgatcgcgaatctgcagggaattcaatggtatatcgcggatatggcgaccaaaaccgccgcggcacgcgcacttgttgagtttgcagcgtatcttgaagacgcgggtaaaccgttcacaaaggaatctgctatgtgcaagctgaacgcctccgaaaacgcgcgttttgtgacaaatttagctctgcagattcacgggggttacggttatatgaaagattatccgttagagcgtatgtatcgcgatgctaagattacggaaatttacgaggggacatcagaaatccataaggtggtgattgcgcgtgaagtaatgaaacgctaa

SEQ ID NO: 187 - DNA, 7012 bp, Artificial Sequence
  Description of Artificial Sequence: Synthetic polynucleotide
caactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatgtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcgtgcggtactgatcgagaagtccgatgatacacagtccgtctctgtcaccgaactggctgaagatcaactgccggaaggcgacgttttggtagatgttgcttattcaacactgaactacaaagacgccctggcaattaccggtaaagcccccgtcgttcgtcgttttccgatggtacctggaatcgactttacgggtaccgtggcccagtcttcccacgccgacttcaagccaggtgatcgcgtaatcctgaatggttggggtgtgggggaaaaacattggggcggtttagcggagcgcgctcgcgtgcgcggagactggcttgttcccttgccagcccccctggacttacgccaagcggccatgatcggtacagcaggatacacggcgatgttgtgcgttctggcgcttgaacgtcacggagtggtgccgggtaatggggaaatcgtggtgtccggtgcagcaggcggcgtcggctccgttgcgacgacccttcttgccgctaagggctatgaggtagcggcagtgactggacgtgcgtccgaagcagaatatctgcgcggtttgggggcggcgagcgtaattgatcgtaacgaattaacggggaaggtacgcccgctgggtcaggagcgttgggctggcgggattgacgtggcgggatcaaccgtgcttgcgaacatgctttctatgatgaagtatcgcggggtagtcgctgcgtgtggcctggccgcgggcatggatctgcccgcgtctgtcgcgccctttattcttcgtgggatgacgctggcaggggtggatagcgttatgtgcccaaagacagatcgtttagcagcgtgggcccgtttggcgtcagatcttgaccctgccaagctggaggagatgactacagagttgccgtttagtgaagtaatcgagacagcacccaaattcttggacgggacggttcgtggccgcattgttatccccgtaacgccctaagaactctagaaataattttgtttaactttaagaaggagatatacatatgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcggatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagtagatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttt

SEQ ID NO: 188 - DNA, 5829 bp, Artificial Sequence
  Description of Artificial Sequence: Synthetic polynucleotide
atgcgtgcggtactgatcgagaagtccgatgatacacagtccgtctctgtcaccgaactggctgaagatcaactgccggaaggcgacgttttggtagatgttgcttattcaacactgaactacaaagacgccctggcaattaccggtaaagcccccgtcgttcgtcgttttccgatggtacctggaatcgactttacgggtaccgtggcccagtcttcccacgccgacttcaagccaggtgatcgcgtaatcctgaatggttggggtgtgggggaaaaacattggggcggtttagcggagcgcgctcgcgtgcgcggagactggcttgttcccttgccagcccccctggacttacgccaagcggccatgatcggtacagcaggatacacggcgatgttgtgcgttctggcgcttgaacgtcacggagtggtgccgggtaatggggaaatcgtggtgtccggtgcagcaggcggcgtcggctccgttgcgacgacccttcttgccgctaagggctatgaggtagcggcagtgactggacgtgcgtccgaagcagaatatctgcgcggtttgggggcggcgagcgtaattgatcgtaacgaattaacggggaaggtacgcccgctgggtcaggagcgttgggctggcgggattgacgtggcgggatcaaccgtgcttgcgaacatgctttctatgatgaagtatcgcggggtagtcgctgcgtgtggcctggccgcgggcatggatctgcccgcgtctgtcgcgccctttattcttcgtgggatgacgctggcaggggtggatagcgttatgtgcccaaagacagatcgtttagcagcgtgggcccgtttggcgtcagatcttgaccctgccaagctggaggagatgactacagagttgccgtttagtgaagtaatcgagacagcacccaaattcttggacgggacggttcgtggccgcattgttatccccgtaacgccctaagaactctagaaataattttgtttaactttaagaaggagatatacatatgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcggatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagta

SEQ ID NO: 189 - DNA, 99 bp, Artificial Sequence
  Description of Artificial Sequence: Synthetic oligonucleotide
catgctgatggttctttctctgatgagatgaacaccattcttgataatcttgccgccagggactttataaactggttgattcagaccaaaatcactgac

SEQ ID NO: 190 - DNA, 102 bp, Artificial Sequence
  Description of Artificial Sequence: Synthetic polynucleotide
catgctgacggctctttttctgacgaaatgaataccatcctggataatctggcggcgcgtgattttattaattggctgatccaaactaaaattactgattaa

SEQ ID NO: 191 - DNA, 162 bp, Artificial Sequence
  Description of Artificial Sequence: Synthetic polynucleotide
atggcacaagtcattaataccaacagcctctcgctgatcactcaaaataatatcaacaagcatgctgacggctctttttctgacgaaatgaataccatcctggataatctggcggcgcgtgattttattaattggctgatccaaactaaaattactgattaa

SEQ ID NO: 192 - DNA, 105 bp, Artificial Sequence
  Description of Artificial Sequence: Synthetic polynucleotide
atgcatgctgacggctctttttctgacgaaatgaataccatcctggataatctggcggcgcgtgattttattaattggctgatccaaactaaaattactgattaa

SEQ ID NO: 193 - DNA, 450 bp, Artificial Sequence
  Description of Artificial Sequence: Synthetic polynucleotide
atgggtactgaccaatgtgataatttcccacaaatgctgcgtgatttgcgcgacgctttctcgcgtgtgaaaactttttttcagactaaagatgaggtggataatctgctgctgaaagagagcctgttggaagattttaaaggctacttgggctgtcaagcgctgtcggagatgattcaattttatctggaagaggtgatgccgcaagctgagaaccaagatccggaagcgaaagatcacgtgaattcgctgggcgagaatctgaaaactctgcgtctgcgtctgcgtcgttgtcaccgttttttgccgtgcgaaaacaaaagtaaagctgttgagcaaattaaaaacgcttttaacaaactgcaggaaaaaggtatctataaagcgatgagcgaatttgatatttttattaattatattgaagcttatatgactattaaagctcgctaa

SEQ ID NO: 194 - DNA, 444 bp, Artificial Sequence
  Description of Artificial Sequence: Synthetic polynucleotide
ggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgccgttgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccagg

SEQ ID NO: 195 - DNA, 441 bp, Artificial Sequence
  Description of Artificial Sequence: Synthetic polynucleotide
gcaccgatctcttcccactgtcgcttagataaatcgaattttcaacaaccttatattacgaatcgtacgtttatgctggctaaagaagcgtcattagctgataacaacactgatgttcgcctgattggtgagaaattgtttcacggtgtgtctatgtcagaacgttgctacctgatgaaacaagttctgaatttcaccctggaagaagtgttgtttccgcaatctgaccgctttcaaccgtatatgcaagaggttgtgccgtttctggcgcgcctgagtaatcgcctgagcacttgtcatattgagggcgacgacctgcatattcaacgaaatgttcaaaaattgaaagatacggtgaagaaactgggtgaaagtggtgaaatcaaagcgattggtgagctggatctgctgtttatgtcattgcgcaatgcgtgcatttaa

SEQ ID NO: 196 - DNA, 444 bp, Artificial Sequence
  Description of Artificial Sequence: Synthetic polynucleotide
atggcaccgatctcttcccactgtcgcttagataaatcgaattttcaacaaccttatattacgaatcgtacgtttatgctggctaaagaagcgtcattagctgataacaacactgatgttcgcctgattggtgagaaattgtttcacggtgtgtctatgtcagaacgttgctacctgatgaaacaagttctgaatttcaccctggaagaagtgttgtttccgcaatctgaccgctttcaaccgtatatgcaagaggttgtgccgtttctggcgcgcctgagtaatcgcctgagcacttgtcatattgagggcgacgacctgcatattcaacgaaatgttcaaaaattgaaagatacggtgaagaaactgggtgaaagtggtgaaatcaaagcgattggtgagctggatctgctgtttatgtcattgcgcaatgcgtgcatttaa

SEQ ID NO: 197 - DNA, 483 bp, Artificial Sequence
  Description of Artificial Sequence: Synthetic polynucleotide
tcgccaggtcaaggaacgcagtcagagaattcatgcactcactttccgggcaatctgccgaatatgctgcgcgatctgcgagatgcattctctcgcgtgaaaacgttctttcaaatgaaagatcaactggataatctgctgctgaaggagtcgttgttggaggattttaaggggtatctgggttgtcaagcactgtctgaaatgattcaattttacttggaggaagttatgccgcaagcggaaaaccaagatccggatattaaggcgcacgtgaactcactgggcgaaaacctgaaaactttgcgcctgcgtctgagacgatgtcaccgattcctgccgtgtgaaaacaagtcaaaggcggttgagcaagttaagaatgctttcaataagctgcaagaaaagggcatctataaagcgatgtctgaatttgatatctttataaactacatagaagcttatatgactatgaagattcgaaattaa

SEQ ID NO: 198 - DNA, 501 bp, Artificial Sequence
  Description of Artificial Sequence: Synthetic polynucleotide
tcgccaggtcaaggaacgcagtcagagaattcatgcactcactttccgggcaatctgccgaatatgctgcgcgatctgcgagatgcattctctcgcgtgaaaacgttctttcaaatgaaagatcaactggataatctgctgctgaaggagtcgttgttggaggattttaaggggtatctgggttgtcaagcactgtctgaaatgattcaattttacttggaggaagttatgccgcaagcggaaaaccaagatccggatattaaggcgcacgtgaactcactgggcgaaaacctgaaaactttgcgcctgcgtctgagacgatgtcaccgattcctgccgtgtgaaaacggaggaggaagtggtggtaagtcaaaggcggttgagcaagttaagaatgctttcaataagctgcaagaaaagggcatctataaagcgatgtctgaatttgatatctttataaactacatagaagcttatatgactatgaagattcgaaattaa

SEQ ID NO: 199 - DNA, 138 bp, Artificial Sequence
  Description of Artificial Sequence: Synthetic polynucleotide
tgacggcgattgagccgacgggtggaaacccaaaacgtaatcaacgtgggtactccttaaattgggttcgaatggaccatggcacaagtcattaataccaacagcctctcgctgatcactcaaaataatatcaacaag

SEQ ID NO: 200 - DNA, 70 bp, Artificial Sequence
  Description of Artificial Sequence: Synthetic oligonucleotide
tgacggcgattgagccgacgggtggaaacccaaaacgtaatcaactacgaacacttacaggaggtaccca

SEQ ID NO: 201 - DNA, 70 bp, Artificial Sequence
  Description of Artificial Sequence: Synthetic oligonucleotide
tgacggcgattgagccgacgggtggaaacccaaaacgtaatcaactcaaatcccttaataaggaggtaaa

SEQ ID NO: 202 - DNA, 106 bp, Artificial Sequence
  Description of Artificial Sequence: Synthetic polynucleotide
ctctagaaataattttgtttaactttaagaaggagatatacatatgaaacaaagcactattgcactggcactcttaccgttactgtttacccctgtgacaaaagcg

SEQ ID NO: 203 - DNA, 63 bp, Artificial Sequence
  Description of Artificial Sequence: Synthetic oligonucleotide
atgaaacaaagcactattgcactggcactcttaccgttactgtttacccctgtgacaaaagcg

SEQ ID NO: 204 - DNA, 109 bp, Artificial Sequence
  Description of Artificial Sequence: Synthetic polynucleotide
ctctagaaataattttgtttaactttaagaaggagatatacatatgatgaagcgcaatattctggcagtgatcgtccctgctctgttagtagcaggtactgcaaacgct

SEQ ID NO: 205 - DNA, 66 bp, Artificial Sequence
  Description of Artificial Sequence: Synthetic oligonucleotide
atgatgaagcgcaatattctggcagtgatcgtccctgctctgttagtagcaggtactgcaaacgct

SEQ ID NO: 206 - DNA, 88 bp, Artificial Sequence
  Description of Artificial Sequence: Synthetic oligonucleotide
ctctagaaataattttgtttaactttaagaaggagatatacatatgagaactctgactctaaatgaattagattctgtttctggtggt

SEQ ID NO: 207 - DNA, 45 bp, Artificial Sequence
  Description of Artificial Sequence: Synthetic oligonucleotide
atgagaactctgactctaaatgaattagattctgtttctggtggt

SEQ ID NO: 208 - DNA, 88 bp, Artificial Sequence
  Description of Artificial Sequence: Synthetic oligonucleotide
gacgccagagagttaagggggttaaatgaaacaatcgaccatcgcattggcgctgcttcctctattgttcacaccggtgacaaaggca

SEQ ID NO: 209 - DNA, 63 bp, Artificial Sequence
  Description of Artificial Sequence: Synthetic oligonucleotide
atgaaacaatcgaccatcgcattggcgctgcttcctctattgttcacaccggtgacaaaggca

SEQ ID NO: 210 - DNA, 160 bp, Artificial Sequence
  Description of Artificial Sequence: Synthetic polynucleotide
ctctagaaataattttgtttaactttaagaaggagatatacatatgaacaataacgatctctttcaggcatcacgtcggcgttttctggcacaactcggcggcttaaccgtcgccgggatgctggggccgtcattgttaacgccgcgacgtgcgactgcg

SEQ ID NO: 211 - DNA, 117 bp, Artificial Sequence
  Description of Artificial Sequence: Synthetic polynucleotide
atgaacaataacgatctctttcaggcatcacgtcggcgttttctggcacaactcggcggcttaaccgtcgccgggatgctggggccgtcattgttaacgccgcgacgtgcgactgcg

SEQ ID NO: 212 - DNA, 148 bp, Artificial Sequence
  Description of Artificial Sequence: Synthetic polynucleotide
cccacattcgaggtactaaatgaacaataacgatctctttcaggcatcacgtcggcgttttctggcacaactcggcggcttaaccgtcgccgggatgctggggacgtcattgttaacgccgcgccgtgcgactgcggcgcaagcggcg

SEQ ID NO: 213 - DNA, 129 bp, Artificial Sequence
  Description of Artificial Sequence: Synthetic polynucleotide
atgaacaataacgatctctttcaggcatcacgtcggcgttttctggcacaactcggcggcttaaccgtcgccgggatgctggggacgtcattgttaacgccgcgccgtgcgactgcggcgcaagcggcg

SEQ ID NO: 214 - DNA, 130 bp, Artificial Sequence
  Description of Artificial Sequence: Synthetic polynucleotide
accctattacacacctaaggaggccaaatacatggacgtcagtcgcagacaattttttaaaatctgcgcgggcggtatggcgggaacaacagtagcagcattgggctttgccccgaagcaagcactggct

SEQ ID NO: 215 - DNA, 99 bp, Artificial Sequence
  Description of Artificial Sequence: Synthetic oligonucleotide
atggacgtcagtcgcagacaattttttaaaatctgcgcgggcggtatggcgggaacaacagtagcagcattgggctttgccccgaagcaagcactggct

SEQ ID NO: 216 - DNA, 168 bp, Artificial Sequence
  Description of Artificial Sequence: Synthetic polynucleotide
tacgcaaaaaacataatttaagagaggataaacatgaaaacgaaaatccctgatgcggtattggctgctgaggtgagtcgccgtggtttggtaaaaacgacagcgatcggcggcctggcaatggccagcagcgcattaacattaccttttagtcggattgcgcacgct

SEQ ID NO: 217 - DNA, 135 bp, Artificial Sequence
  Description of Artificial Sequence: Synthetic polynucleotide
atgaaaacgaaaatccctgatgcggtattggctgctgaggtgagtcgccgtggtttggtaaaaacgacagcgatcggcggcctggcaatggccagcagcgcattaacattaccttttagtcggattgcgcacgct

SEQ ID NO: 218 - DNA, 712 bp, Artificial Sequence
  Description of Artificial Sequence: Synthetic polynucleotide
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaa

SEQ ID NO: 219 - DNA, 104 bp, Artificial Sequence
  Description of Artificial Sequence: Synthetic polynucleotide
agcgggaataaggggcagagaaaagagtatttcgtcgactaacaaaaaatggctgtttgtgaaaaaaattctaaaggttgttttacgacagacgataacagggt

SEQ ID NO: 220 - DNA, 162 bp, Artificial Sequence
  Description of Artificial Sequence: Synthetic polynucleotide
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatcc

SEQ ID NO: 221 - DNA, 358 bp, Artificial Sequence
  Description of Artificial Sequence: Synthetic polynucleotide
cacatttccccgaaaagtgccgatggccccccgatggtagtgtggcccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttc

SEQ ID NO: 222 - DNA, 48 bp, Artificial Sequence
  Description of Artificial Sequence: Synthetic oligonucleotide
gaagttcctatactttctagagaataggaacttcggaataggaacttc

SEQ ID NO: 223 - DNA, 1345 bp, Artificial Sequence
  Description of Artificial Sequence: Synthetic polynucleotide
aagatcccctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccagcttcaaaagcgctct

SEQ ID NO: 224 - DNA, 2388 bp, Artificial Sequence
  Description of Artificial Sequence: Synthetic polynucleotide
cgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcggacgattagtgggtgaaatgaggggttatttgggggttaccggtaaattgcgggcagaaaaaaccccgccgttggcggggaagcacgttgctggcaaattaccattcatgttgccggatgcggcgtaaacgccttatccggcctacaaaaatgtgcaaattcaataaattgcaattccccttgtaggcctgataagcgcagcgcatcaggcaatttggcgttgccgtcagtctcagttaatcaggttacggcgattaatcagtaattttagtttggatcagccaattaataaaatcacgcgccgccagattatccaggatggtattcatttcgtcagaaaaagagccgtcagcatgcattaggaacctcccagagtttatacttgttgattacgttttgggtttccacccgtcggctcaatcgccgtcaaccctgttatcgtctgtcgtaaaacaacctttagaatttttttcacaaacagccattttttgttagtcgacgaaatactcttttctctgccccttattcccgctattaaaaaaaacaattaaacgtaaactttgcgcaattcaggccgataaccccggtattcgttttacgtgtcgaaagataaacgaagttcctatactttctagagaataggaacttcggaataggaacttcatttctcgttcgctgccacctaagaatactctacggtcacatacaaatggcgcgccttacgccccgccctgccactcatcgcagtactgttgtattcattaagcatctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcggaataggaactctcaccgccgcgcaaaaagcgacgctaacccctatttcaaatcagcaatcgtcgtttaccgctaaacttagcgcctacggtacgctgaaaagcgcgctgacgactttccagaccgccaatactgcattgtctaaagccgatcttttttccgctaccagcaccaccagcagcaccaccgcgttcagtgccaccaccgcgggtaatgccatcgccgggaaatacaccatcagcgtcacccatctggcgcaggcgcaaaccctgacaacgcgcaccaccagagacgatacgaaaacggcgatcgccaccagcgacagcaaactcaccattcaacaaggcggcgacaaagatccgatttccattgatatcagcgcggctaactcgtctttaagcgggatccgtgatgccatcaacaacgcaaaagcaggcgtaagcgcaagcatcattaacgtgggtaacggtgaatatcgtctgtcagtcacatcaaatgacaccggcct

SEQ ID NO: 225 - DNA, 176 bp, Artificial Sequence
  Description of Artificial Sequence: Synthetic polynucleotide
attaatcagtaattttagtttggatcagccaattaataaaatcacgcgccgccagattatccaggatggtattcatttcgtcagaaaaagagccgtcagcatgcattaggaacctcccagagtttatacttgttgattacgttttgggtttccacccgtcggctcaatcgccgtca

SEQ ID NO: 226 - DNA, 3118 bp, Artificial Sequence
  Description of Artificial Sequence: Synthetic polynucleotide
cgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcggacgattagtgggtgaaatgaggggttatttgggggttaccggtaaattgcgggcagaaaaaaccccgccgttggcggggaagcacgttgctggcaaattaccattcatgttgccggatgcggcgtaaacgccttatccggcctacaaaaatgtgcaaattcaataaattgcaattccccttgtaggcctgataagcgcagcgcatcaggcaatttggcgttgccgtcagtctcagttaatcaggttacggcgattaatcagtaattttagtttggatcagccaattaataaaatcacgcgccgccagattatccaggatggtattcatttcgtcagaaaaagagccgtcagcatgcttgttgatattattttgagtgatcagcgagaggctgttggtattaatgacttgtgccatggtccattcgaacccaatttaaggagtacccacgttgattacgttttgggtttccacccgtcggctcaatcgccgtcattctctatcactgatagggagtggtaaaataactctatcaatgatagagtgtcaacaaaaattaggaattaatgatgtctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgggctttgctcgacgccttagccattgagatgttagataggcaccatactcacttttgccctttagaaggggaaagctggcaagattttttacgtaataacgctaaaagttttagatgtgctttactaagtcatcgcgatggagcaaaagtacatttaggtacacggcctacagaaaaacagtatgaaactctcgaaaatcaattagcctttttatgccaacaaggtttttcactagagaatgcattatatgcactcagcgctgtggggcattttactttaggttgcgtattggaagatcaagagcatcaagtcgctaaagaagaaagggaaacacctactactgatagtatgccgccattattacgacaagctatcgaattatttgatcaccaaggtgcagagccagccttcttattcggccttgaattgatcatatgcggattagaaaaacaacttaaatgtgaaagtgggtcttaagaatttttttcacaaacagccattttttgttagtcgacgaaatactcttttctctgccccttattcccgctattaaaaaaaacaattaaacgtaaactttgcgcaattcaggccgataaccccggtattcgttttacgtgtcgaaagataaacgaagttcctatactttctagagaataggaacttcggaataggaacttcatttctcgttcgctgccacctaagaatactctacggtcacatacaaatggcgcgccttacgccccgccctgccactcatcgcagtactgttgtattcattaagcatctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcggaataggaactctcaccgccgcgcaaaaagcgacgctaacccctatttcaaatcagcaatcgtcgtttaccgctaaacttagcgcctacggtacgctgaaaagcgcgctgacgactttccagaccgccaatactgcattgtctaaagccgatcttttttccgctaccagcaccaccagcagcaccaccgcgttcagtgccaccaccgcgggtaatgccatcgccgggaaatacaccatcagcgtcacccatctggcgcaggcgcaaaccctgacaacgcgcaccaccagagacgatacgaaaacggcgatcgccaccagcgacagcaaactcaccattcaacaaggcggcgacaaagatccgatttccattgatatcagcgcggctaactcgtctttaagcgggatccgtgatgccatcaacaacgcaaaagcaggcgtaagcgcaagcatcattaacgtgggtaacggtgaatatcgtctgtcagtcacatcaaatgacaccggcct

SEQ ID NO: 227 - DNA, 162 bp, Artificial Sequence
  Description of Artificial Sequence: Synthetic polynucleotide
ttaatcagtaattttagtttggatcagccaattaataaaatcacgcgccgccagattatccaggatggtattcatttcgtcagaaaaagagccgtcagcatgcttgttgatattattttgagtgatcagcgagaggctgttggtattaatgacttgtgccat

SEQ ID NO: 228 - DNA, 1326 bp, Artificial Sequence
  Description of Artificial Sequence: Synthetic polynucleotide
ttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgatgaagcgcaatattctggcagtgatcgtccctgctctgttagtagcaggtactgcaaacgctcatgctgatggttctttctctgatgagatgaacaccattcttgataatcttgccgccagggactttataaactggttgattcagaccaaaatcactgacaggtgacacatttccccgaaaagtgccgatggccccccgatggtagtgtggccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttcgaagttcctatactttctagagaataggaacttcggaataggaacttc

SEQ ID NO: 229 - DNA, 171 bp, Artificial Sequence
  Description of Artificial Sequence: Synthetic polynucleotide
atgatgaagcgcaatattctggcagtgatcgtccctgctctgttagtagcaggtactgcaaacgctcatgctgatggttctttctctgatgagatgaacaccattcttgataatcttgccgccagggactttataaactggttgattcagaccaaaatcactgacaggtga

SEQ ID NO: 230 - DNA, 1375 bp, Artificial Sequence
  Description of Artificial Sequence: Synthetic polynucleotide
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgaacaataacgatctctttcaggcatcacgtcggcgttttctggcacaactcggcggcttaaccgtcgccgggatgctggggccgtcattgttaacgccgcgacgtgcgactgcgcatgctgatggttctttctctgatgagatgaacaccattcttgataatcttgccgccagggactttataaactggttgattcagaccaaaatcactgactaataacacatttccccgaaaagtgccgatggccccccgatggtagtgtggcccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttcgaagttcctatactttctagagaataggaacttcggaataggaacttc

SEQ ID NO: 231 - DNA, 216 bp, Artificial Sequence
  Description of Artificial Sequence: Synthetic polynucleotide
atgaacaataacgatctctttcaggcatcacgtcggcgttttctggcacaactcggcggcttaaccgtcgccgggatgctggggccgtcattgttaacgccgcgacgtgcgactgcgcatgctgatggttctttctctgatgagatgaacaccattcttgataatcttgccgccagggactttataaactggttgattcagaccaaaatcactgac

SEQ ID NO: 232 - DNA, 1283 bp, Artificial Sequence
  Description of Artificial Sequence: Synthetic polynucleotide
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagacgccagagagttaagggggttaaatgaaacaatcgaccatcgcattggcgctgcttcctctattgttcacaccggtgacaaaggcatcgccaggtcaaggaacgcagtcagagaattcatgcactcactttccgggcaatctgccgaatatgctgcgcgatctgcgagatgcattctctcgcgtgaaaacgttctttcaaatgaaagatcaactggataatctgctgctgaaggagtcgttgttggaggattttaaggggtatctgggttgtcaagcactgtctgaaatgattcaattttacttggaggaagttatgccgcaagcggaaaaccaagatccggatattaaggcgcacgtgaactcactgggcgaaaacctgaaaactttgcgcctgcgtctgagacgatgtcaccgattcctgccgtgtgaaaacaagtcaaaggcggttgagcaagttaagaatgctttcaataagctgcaagaaaagggcatctataaagcgatgtctgaatttgatatctttataaactacatagaagcttatatgactatgaagattcgaaattaa

SEQ ID NO: 233 - DNA, 571 bp, Artificial Sequence
  Description of Artificial Sequence: Synthetic polynucleotide
gacgccagagagttaagggggttaaatgaaacaatcgaccatcgcattggcgctgcttcctctattgttcacaccggtgacaaaggcatcgccaggtcaaggaacgcagtcagagaattcatgcactcactttccgggcaatctgccgaatatgctgcgcgatctgcgagatgcattctctcgcgtgaaaacgttctttcaaatgaaagatcaactggataatctgctgctgaaggagtcgttgttggaggattttaaggggtatctgggttgtcaagcactgtctgaaatgattcaattttacttggaggaagttatgccgcaagcggaaaaccaagatccggatattaaggcgcacgtgaactcactgggcgaaaacctgaaaactttgcgcctgcgtctgagacgatgtcaccgattcctgccgtgtgaaaacaagtcaaaggcggttgagcaagttaagaatgctttcaataagctgcaagaaaagggcatctataaagcgatgtctgaatttgatatctttataaactacatagaagcttatatgactatgaagattcgaaattaa

SEQ ID NO: 234 - DNA, 520 bp, Artificial Sequence
  Description of Artificial Sequence: Synthetic polynucleotide
tgacggcgattgagccgacgggtggaaacccaaaacgtaatcaactcaaatcccttaataaggaggtaaaatgggtactgaccaatgtgataatttcccacaaatgctgcgtgatttgcgcgacgctttctcgcgtgtgaaaactttttttcagactaaagatgaggtggataatctgctgctgaaagagagcctgttggaagattttaaaggctacttgggctgtcaagcgctgtcggagatgattcaattttatctggaagaggtgatgccgcaagctgagaaccaagatccggaagcgaaagatcacgtgaattcgctgggcgagaatctgaaaactctgcgtctgcgtctgcgtcgttgtcaccgttttttgccgtgcgaaaacaaaagtaaagctgttgagcaaattaaaaacgcttttaacaaactgcaggaaaaaggtatctataaagcgatgagcgaatttgatatttttattaattatattgaagcttatatgactattaaagctcgctaa

SEQ ID NO: 235 - DNA, 1244 bp, Artificial Sequence
  Description of Artificial Sequence: Synthetic polynucleotide
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagacgccagagagttaagggggttaaatgaaacaatcgaccatcgcattggcgctgcttcctctattgttcacaccggtgacaaaggcaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgccgttgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccagg

SEQ ID NO: 236 - DNA, 532 bp, Artificial Sequence
  Description of Artificial Sequence: Synthetic polynucleotide
gacgccagagagttaagggggttaaatgaaacaatcgaccatcgcattggcgctgcttcctctattgttcacaccggtgacaaaggcaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgccgttgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccagg

SEQ ID NO: 237 - DNA, 1241 bp, Artificial Sequence
  Description of Artificial Sequence: Synthetic polynucleotide
gaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaagacgccagagagttaagggggttaaatgaaacaatcgaccatcgcattggcgctgcttcctctattgttcacaccggtgacaaaggcagcaccgatctcttcccactgtcgcttagataaatcgaattttcaacaaccttatattacgaatcgtacgtttatgctggctaaagaagcgtcattagctgataacaacactgatgttcgcctgattggtgagaaattgtttcacggtgtgtctatgtcagaacgttgctacctgatgaaacaagttctgaatttcaccctggaagaagtgttgtttccgcaatctgaccgctttcaaccgtatatgcaagaggttgtgccgtttctggcgcgcctgagtaatcgcctgagcacttgtcatattgagggcgacgacctgcatattcaacgaaatgttcaaaaattgaaagatacggtgaagaaactgggtgaaagtggtgaaatcaaagcgattggtgagctggatctgctgtttatgtcattgcgcaatgcgtgcatttaa

SEQ ID NO: 238 - DNA, 529 bp, Artificial Sequence
  Description of Artificial Sequence: Synthetic polynucleotide
gacgccagagagttaagggggttaaatgaaacaatcgaccatcgcattggcgctgcttcctctattgttcacaccggtgacaaaggcagcaccgatctcttcccactgtcgcttagataaatcgaattttcaacaaccttatattacgaatcgtacgtttatgctggctaaagaagcgtcattagctgataacaacactgatgttcgcctgattggtgagaaattgtttcacggtgtgtctatgtcagaacgttgctacctgatgaaacaagttctgaatttcaccctggaagaagtgttgtttccgcaatctgaccgctttcaaccgtatatgcaagaggttgtgccgtttctggcgcgcctgagtaatcgcctgagcacttgtcatattgagggcgacgacctgcatattcaacgaaatgttcaaaaattgaaagatacggtgaagaaactgggtgaaagtggtgaaatcaaagcgattggtgagctggatctgctgtttatgtcattgcgcaatgcgtgcatttaa

SEQ ID NO: 239 - DNA, 88 bp, Artificial Sequence; identical to SEQ ID NO: 208
  Description of Artificial Sequence: Synthetic oligonucleotide

SEQ ID NO: 240 - DNA, 3383 bp, Artificial Sequence
  Description of Artificial Sequence: Synthetic polynucleotide
ggtaccgtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaaatgagcaaagtcagactcgcaattatggatcctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 241 - DNA, 3258 bp, Artificial Sequence
  Description of Artificial Sequence: Synthetic polynucleotide
ggtacccatttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacctatgacgacctacgatcgggatcctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 242 - DNA, 3386 bp, Artificial Sequence
  Description of Artificial Sequence: Synthetic polynucleotide
ggtaccgtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggatccctctagaaataattttgtttaactttaagaaggagatatacatatgactatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 243 - DNA, 3261 bp, Artificial Sequence
  Description of Artificial Sequence: Synthetic polynucleotide
ggtacccatttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacatatgactatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 244 - DNA, 3279 bp, Artificial Sequence
  Description of Artificial Sequence: Synthetic polynucleotide
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccctctagaaataattttgtttaactttaagaaggagatatacatatgctatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 245 - DNA, 1420 bp, Artificial Sequence
  Description of Artificial Sequence: Synthetic polynucleotide
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatggctagcaaaggcgaagaattgttcacgggcgttgttcctattttggttgaattggatggcgatgttaatggccataaattcagcgttagcggcgaaggcgaaggcgatgctacgtatggcaaattgacgttgaaattcatttgtacgacgggcaaattgcctgttccttggcctacgttggttacgacgttcagctatggcgttcaatgtttcagccgttatcctgatcatatgaaacgtcatgatttcttcaaaagcgctatgcctgaaggctatgttcaagaacgtacgattagcttcaaagatgatggcaattataaaacgcgtgctgaagttaaattcgaaggcgatacgttggttaatcgtattgaattgaaaggcattgatttcaaagaagatggcaatattttgggccataaattggaatataattataatagccataatgtttatattacggctgataaacaaaaaaatggcattaaagctaatttcaaaattcgtcataatattgaagatggcagcgttcaattggctgatcattatcaacaaaatacgcctattggcgatggccctgttttgttgcctgataatcattatttgagcacgcaaagcgctttgagcaaagatcctaatgaaaaacgtgatcatatggttttgttggaattcgttacggctgctggcattacgcatggcatggatgaattgtataaataataa

SEQ ID NO: 246 - DNA, 60 bp, Artificial Sequence
  Description of Artificial Sequence: Synthetic primer
tagaactgatgcaaaaagtgctcgacgaaggcacacagatgtgtaggctggagctgcttc

SEQ ID NO: 247 - DNA, 60 bp, Artificial Sequence
  Description of Artificial Sequence: Synthetic primer
gtttcgtaattagatagccaccggcgctttaatgcccggacatatgaatatcctccttag

SEQ ID NO: 248 - DNA, 52 bp, Artificial Sequence
  Description of Artificial Sequence: Synthetic primer
caacacgtttcctgaggaaccatgaaacagtatttagaactgatgcaaaaag

SEQ ID NO: 249 - DNA, 46 bp, Artificial Sequence
  Description of Artificial Sequence: Synthetic primer
cgcacactggcgtcggctctggcaggatgtttcgtaattagatagc

SEQ ID NO: 250 - DNA, 36 bp, Artificial Sequence
  Description of Artificial Sequence: Synthetic primer
atatcgtcgcagcccacagcaacacgtttcctgagg

SEQ ID NO: 251 - DNA, 47 bp, Artificial Sequence
  Description of Artificial Sequence: Synthetic primer
aagaatttaacggagggcaaaaaaaaccgacgcacactggcgtcggc

SEQ ID NO: 252 - DNA, 1096 bp, Artificial Sequence
  Description of Artificial Sequence: Synthetic polynucleotide
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaa

SEQ ID NO: 253 - DNA, 2351 bp, Artificial Sequence
  Description of Artificial Sequence: Synthetic polynucleotide
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaatcaggttgatctggatgcggcggcaaagcgcgggatcccggtatttaacgcaccgttctcaaatacgcgctctgttgcggagctggtgattggcgaactgctgctgctattgcgcggcgtgccagaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaagcccggctcgctgctgattaatgcttcgcgcggtactgtggtggatattccagcgctgtgtgacgcgctggcgagcaaacatctggcgggggcggcaatcgacgtattcccgacggaaccggcgaccaatagcgatccatttacctctccgctgtgtgaattcgacaatgtccttctgacgccacacattggcggttcgactcaggaagcgcaggagaatatcggcttggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctcaacaaaatttttgccgagcagggcgtcaacatcgccgcgcaatatctacaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 254 - DNA, 1233 bp, Artificial Sequence
  Description of Artificial Sequence: Synthetic polynucleotide
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaatcaggttgatctggatgcggcggcaaagcgcgggatcccggtatttaacgcaccgttctcaaatacgcgctctgttgcggagctggtgattggcgaactgctgctgctattgcgcggcgtgccagaagccaatgctaaagcgcatcgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaacaaactgccgctgggcaacgccactcaggtacagcatctttctgacctgctgaatatgagcgatgtggtgagtctgcatgtaccagagaatccgtccaccaaaaatatgatgggcgcgaaagagatttcgctaatgaagcccggctcgctgctgattaatgcttcgcgcggtactgtggtggatattccagcgctgtgtgacgcgctggcgagcaaacatctggcgggggcggcaatcgacgtattcccgacggaaccggcgaccaatagcgatccatttacctctccgctgtgtgaattcgacaatgtccttctgacgccacacattggcggttcgactcaggaagcgcaggagaatatcggcttggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctcaacaaaatttttgccgagcagggcgtcaacatcgccgcgcaatatctacaaacttccgcccagatgggttatgtagttattgatattgaagccgacgaagacgttgccgaaaaagcgctgcaggcaatgaaagctattccgggtaccattcgcgcccgtctgctgtactaa

SEQ ID NO: 255 - DNA, 2621 bp, Artificial Sequence
  Description of Artificial Sequence: Synthetic polynucleotide
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatgggttctattgactcgacgaatgtggccatgtctaattctcctgttggcgagtttaagccccttgaagcagaagagttccgtaaacaggcacaccgcatggtggattttattgcggattattacaagaacgtagaaacatacccggtcctttccgaggttgaacccggctatctgcgcaaacgtattcccgaaaccgcaccatacctgccggagccacttgatgatattatgaaggatattcaaaaggacattatccccggaatgacgaactggatgtccccgaacttttacgccttcttcccggccacagttagctcagcagctttcttgggggaaatgctttcaacggcccttaacagcgtaggatttacctgggtcagttccccggcagcgactgaattagagatgatcgttatggattggcttgcgcaaattttgaaacttccaaaaagctttatgttctccggaaccgggggtggtgtcatccaaaacactacgtcagagtcgatcttgtgcactattatcgcggcccgtgaacgcgccttggaaaaattgggccctgattcaattggtaagcttgtctgctatgggtccgatcaaacgcacacaatgtttccgaaaacctgtaagttagcaggaatttatccgaataatatccgccttatccctaccacggtagaaaccgactttggcatctcaccgcaggtacttcgcaagatggtcgaagacgacgtcgctgcggggtacgttcccttatttttgtgtgccaccttgggaacgacatcaactacggcaacagatcctgtagattcgctgtccgaaatcgcaaacgagtttggtatctggattcatgtcgacgccgcatatgctggatcggcttgcatctgcccagaatttcgtcactaccttgatggcatcgaacgtgtggattccttatcgctgtctccccacaaatggcttttagcatatctggattgcacgtgcttgtgggtaaaacaacctcacctgctgcttcgcgctttaacgactaatcccgaatacttgaagaataaacagagtgatttagataaggtcgtggattttaagaactggcagatcgcaacaggacgtaagttccgctctttaaaactttggttaattctgcgttcctacggggtagttaacctgcaaagtcatatccgtagtgatgtagcgatggggaagatgtttgaggaatgggtccgttccgatagccgctttgaaatcgtcgtgccacgtaatttttcgcttgtatgctttcgcttgaaaccggatgtatctagtttacatgtcgaggaggtcaacaagaagttgttggatatgcttaactccaccggtcgcgtatatatgacgcatacaattgttggcggaatctatatgttacgtttggctgtaggtagcagcttgacagaggaacatcacgtgcgccgcgtttgggacttgatccagaagcttacggacgacctgcttaaagaggcgtga

SEQ ID NO: 256 - DNA, 1503 bp, Artificial Sequence
  Description of Artificial Sequence: Synthetic polynucleotide
atgggttctattgactcgacgaatgtggccatgtctaattctcctgttggcgagtttaagccccttgaagcagaagagttccgtaaacaggcacaccgcatggtggattttattgcggattattacaagaacgtagaaacatacccggtcctttccgaggttgaacccggctatctgcgcaaacgtattcccgaaaccgcaccatacctgccggagccacttgatgatattatgaaggatattcaaaaggacattatccccggaatgacgaactggatgtccccgaacttttacgccttcttcccggccacagttagctcagcagctttcttgggggaaatgctttcaacggcccttaacagcgtaggatttacctgggtcagttccccggcagcgactgaattagagatgatcgttatggattggcttgcgcaaattttgaaacttccaaaaagctttatgttctccggaaccgggggtggtgtcatccaaaacactacgtcagagtcgatcttgtgcactattatcgcggcccgtgaacgcgccttggaaaaattgggccctgattcaattggtaagcttgtctgctatgggtccgatcaaacgcacacaatgtttccgaaaacctgtaagttagcaggaatttatccgaataatatccgccttatccctaccacggtagaaaccgactttggcatctcaccgcaggtacttcgcaagatggtcgaagacgacgtcgctgcggggtacgttcccttatttttgtgtgccaccttgggaacgacatcaactacggcaacagatcctgtagattcgctgtccgaaatcgcaaacgagtttggtatctggattcatgtcgacgccgcatatgctggatcggcttgcatctgcccagaatttcgtcactaccttgatggcatcgaacgtgtggattccttatcgctgtctccccacaaatggcttttagcatatctggattgcacgtgcttgtgggtaaaacaacctcacctgctgcttcgcgctttaacgactaatcccgaatacttgaagaataaacagagtgatttagataaggtcgtggattttaagaactggcagatcgcaacaggacgtaagttccgctctttaaaactttggttaattctgcgttcctacggggtagttaacctgcaaagtcatatccgtagtgatgtagcgatggggaagatgtttgaggaatgggtccgttccgatagccgctttgaaatcgtcgtgccacgtaatttttcgcttgtatgctttcgcttgaaaccggatgtatctagtttacatgtcgaggaggtcaacaagaagttgttggatatgcttaactccaccggtcgcgtatatatgacgcatacaattgttggcggaatctatatgttacgtttggctgtaggtagcagcttgacagaggaacatcacgtgcgccgcgtttgggacttgatccagaagcttacggacgacctgcttaaagaggcgtga

SEQ ID NO: 257 - DNA, 5377 bp, Artificial Sequence
  Description of Artificial Sequence: Synthetic polynucleotide
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatgctgttattcgagactgtgcgtgaaatgggtcatgagcaagtccttttctgtcatagcaagaatcccgagatcaaggcaattatcgcaatccacgataccaccttaggaccggctatgggcgcaactcgtatcttaccttatattaatgaggaggctgccctgaaagatgcattacgtctgtcccgcggaatgacttacaaagcagcctgcgccaatattcccgccgggggcggcaaagccgtcatcatcgctaaccccgaaaacaagaccgatgacctgttacgcgcatacggccgtttcgtggacagcttgaacggccgtttcatcaccgggcaggacgttaacattacgcccgacgacgttcgcactatttcgcaggagactaagtacgtggtaggcgtctcagaaaagtcgggagggccggcacctatcacctctctgggagtatttttaggcatcaaagccgctgtagagtcgcgttggcagtctaaacgcctggatggcatgaaagtggcggtgcaaggacttgggaacgtaggaaaaaatctttgtcgccatctgcatgaacacgatgtacaactttttgtgtctgatgtcgatccaatcaaggccgaggaagtaaaacgcttattcggggcgactgttgtcgaaccgactgaaatctattctttagatgttgatatttttgcaccgtgtgcacttgggggtattttgaatagccataccatcccgttcttacaagcctcaatcatcgcaggagcagcgaataaccagctggagaacgagcaacttcattcgcagatgcttgcgaaaaagggtattctttactcaccagactacgttatcaatgcaggaggacttatcaatgtttataacgaaatgatcggatatgacgaggaaaaagcattcaaacaagttcataacatctacgatacgttattagcgattttcgaaattgcaaaagaacaaggtgtaaccaccaacgacgcggcccgtcgtttagcagaggatcgtatcaacaactccaaacgctcaaagagtaaagcgattgcggcgtgaaatgtaagaaggagatatacatatgcgtacaccctactgtgtcgccgattatcttttagatcgtctgacggactgcggggccgatcacctgtttggcgtaccgggcgattacaacttgcagtttctggaccacgtcattgactcaccagatatctgctgggtagggtgtgcgaacgagcttaacgcgagctacgctgctgacggatatgcgcgttgtaaaggctttgctgcacttcttactaccttcggggtcggtgagttatcggcgatgaacggtatcgcaggctcgtacgctgagcacgtcccggtattacacattgtgggagctccgggtaccgcagctcaacagcgcggagaactgttacaccacacgctgggcgacggagaattccgccacttttaccatatgtccgagccaattactgtagcccaggctgtacttacagagcaaaatgcctgttacgagatcgaccgtgttttgaccacgatgcttcgcgagcgccgtcccgggtatttgatgctgccagccgatgttgccaaaaaagctgcgacgcccccagtgaatgccctgacgcataaacaagctcatgccgattccgcctgtttaaaggcttttcgcgatgcagctgaaaataaattagccatgtcgaaacgcaccgccttgttggcggactttctggtcctgcgccatggccttaaacacgcccttcagaaatgggtcaaagaagtcccgatggcccacgctacgatgcttatgggtaaggggatttttgatgaacgtcaagcgggattttatggaacttattccggttcggcgagtacgggggcggtaaaggaagcgattgagggagccgacacagttctttgcgtggggacacgtttcaccgatacactgaccgctggattcacacaccaacttactccggcacaaacgattgaggtgcaaccccatgcggctcgcgtgggggatgtatggtttacgggcattccaatgaatcaagccattgagactcttgtcgagctgtgcaaacagcacgtccacgcaggactgatgagttcgagctctggggcgattccttttccacaaccagatggtagtttaactcaagaaaacttctggcgcacattgcaaacctttatccgcccaggtgatatcatcttagcagaccagggtacttcagcctttggagcaattgacctgcgcttaccagcagacgtgaactttattgtgcagccgctgtgggggtctattggttatactttagctgcggccttcggagcgcagacagcgtgtccaaaccgtcgtgtgatcgtattgacaggagatggagcagcgcagttgaccattcaggagttaggctcgatgttacgcgataagcagcaccccattatcctggtcctgaacaatgaggggtatacagttgaacgcgccattcatggtgcggaacaacgctacaatgacatcgctttatggaattggacgcacatcccccaagccttatcgttagatccccaatcggaatgttggcgtgtgtctgaagcagagcaactggctgatgttctggaaaaagttgctcatcatgaacgcctgtcgttgatcgaggtaatgttgcccaaggccgatatccctccgttactgggagccttgaccaaggctttagaagcctgcaacaacgcttaaaggttaagaaggagatatacatatgcccaccttgaacttggacttacccaacggtattaagagcacgattcaggcagaccttttcatcaataataagtttgtgccggcgcttgatgggaaaacgttcgcaactattaatccgtctacggggaaagagatcggacaggtggcagaggcttcggcgaaggatgtggatcttgcagttaaggccgcgcgtgaggcgtttgaaactacttggggggaaaacacgccaggtgatgctcgtggccgtttactgattaagcttgctgagttggtggaagcgaatattgatgagttagcggcaattgaatcactggacaatgggaaagcgttctctattgctaagtcattcgacgtagctgctgtggccgcaaacttacgttactacggcggttgggctgataaaaaccacggtaaagtcatggaggtagacacaaagcgcctgaactatacccgccacgagccgatcggggtttgcggacaaatcattccgtggaatttcccgcttttgatgtttgcatggaagctgggtcccgctttagccacagggaacacaattgtgttaaagactgccgagcagactcccttaagtgctatcaagatgtgtgaattaatcgtagaagccggctttccgcccggagtagttaatgtgatctcgggattcggaccggtggcgggggccgcgatctcgcaacacatggacatcgataagattgcctttacaggatcgacattggttggccgcaacattatgaaggcagctgcgtcgactaacttaaaaaaggttacacttgagttaggaggaaaatccccgaatatcattttcaaagatgccgaccttgaccaagctgttcgctggagcgccttcggtatcatgtttaaccacggacaatgctgctgcgctggatcgcgcgtatatgtggaagaatccatctatgacgccttcatggaaaaaatgactgcgcattgtaaggcgcttcaagttggagatcctttcagcgcgaacaccttccaaggaccacaagtctcgcagttacaatacgaccgtatcatggaatacatcgaatcagggaaaaaagatgcaaatcttgctttaggcggcgttcgcaaagggaatgaggggtatttcattgagccaactatttttacagacgtgccgcacgacgcgaagattgccaaagaggagatcttcggtccagtggttgttgtgtcgaaatttaaggacgaaaaagatctgatccgtatcgcaaatgattctatttatggtttagctgcggcagtcttttcccgcgacatcagccgcgcgatcgagacagcacacaaactgaaagcaggcacggtctgggtcaactgctataatcagcttattccgcaggtgccattcggagggtataaggcttccggtatcggccgtgagttgggggaatatgccttgtctaattacacaaatatcaaggccgtccacgttaacctttctcaaccggcgcccatttga

SEQ ID NO: 258 - DNA, 1096 bp, Artificial Sequence; identical to SEQ ID NO: 252
  Description of Artificial Sequence: Synthetic polynucleotide

SEQ ID NO: 259 - DNA, 1080 bp, Artificial Sequence
  Description of Artificial Sequence: Synthetic polynucleotide
taagaaggagatatacatatgctgttattcgagactgtgcgtgaaatgggtcatgagcaagtccttttctgtcatagcaagaatcccgagatcaaggcaattatcgcaatccacgataccaccttaggaccggctatgggcgcaactcgtatcttaccttatattaatgaggaggctgccctgaaagatgcattacgtctgtcccgcggaatgacttacaaagcagcctgcgccaatattcccgccgggggcggcaaagccgtcatcatcgctaaccccgaaaacaagaccgatgacctgttacgcgcatacggccgtttcgtggacagcttgaacggccgtttcatcaccgggcaggacgttaacattacgcccgacgacgttcgcactatttcgcaggagactaagtacgtggtaggcgtctcagaaaagtcgggagggccggcacctatcacctctctgggagtatttttaggcatcaaagccgctgtagagtcgcgttggcagtctaaacgcctggatggcatgaaagtggcggtgcaaggacttgggaacgtaggaaaaaatctttgtcgccatctgcatgaacacgatgtacaactttttgtgtctgatgtcgatccaatcaaggccgaggaagtaaaacgcttattcggggcgactgttgtcgaaccgactgaaatctattctttagatgttgatatttttgcaccgtgtgcacttgggggtattttgaatagccataccatcccgttcttacaagcctcaatcatcgcaggagcagcgaataaccagctggagaacgagcaacttcattcgcagatgcttgcgaaaaagggtattctttactcaccagactacgttatcaatgcaggaggacttatcaatgtttataacgaaatgatcggatatgacgaggaaaaagcattcaaacaagttcataacatctacgatacgttattagcgattttcgaaattgcaaaagaacaaggtgtaaccaccaacgacgcggcccgtcgtttagcagaggatcgtatcaacaactccaaacgctcaaagagtaaagcgattgcggcgtga

SEQ ID NO: 260 - DNA, 1674 bp, Artificial Sequence
  Description of Artificial Sequence: Synthetic polynucleotide
gaaggagatatacatatgcgtacaccctactgtgtcgccgattatcttttagatcgtctgacggactgcggggccgatcacctgtttggcgtaccgggcgattacaacttgcagtttctggaccacgtcattgactcaccagatatctgctgggtagggtgtgcgaacgagcttaacgcgagctacgctgctgacggatatgcgcgttgtaaaggctttgctgcacttcttactaccttcggggtcggtgagttatcggcgatgaacggtatcgcaggctcgtacgctgagcacgtcccggtattacacattgtgggagctccgggtaccgcagctcaacagcgcggagaactgttacaccacacgctgggcgacggagaattccgccacttttaccatatgtccgagccaattactgtagcccaggctgtacttacagagcaaaatgcctgttacgagatcgaccgtgttttgaccacgatgcttcgcgagcgccgtcccgggtatttgatgctgccagccgatgttgccaaaaaagctgcgacgcccccagtgaatgccctgacgcataaacaagctcatgccgattccgcctgtttaaaggcttttcgcgatgcagctgaaaataaattagccatgtcgaaacgcaccgccttgttggcggactttctggtcctgcgccatggccttaaacacgcccttcagaaatgggtcaaagaagtcccgatggcccacgctacgatgcttatgggtaaggggatttttgatgaacgtcaagcgggattttatggaacttattccggttcggcgagtacgggggcggtaaaggaagcgattgagggagccgacacagttctttgcgtggggacacgtttcaccgatacactgaccgctggattcacacaccaacttactccggcacaaacgattgaggtgcaaccccatgcggctcgcgtgggggatgtatggtttacgggcattccaatgaatcaagccattgagactcttgtcgagctgtgcaaacagcacgtccacgcaggactgatgagttcgagctctggggcgattccttttccacaaccagatggtagtttaactcaagaaaacttctggcgcacattgcaaacctttatccgcccaggtgatatcatcttagcagaccagggtacttcagcctttggagcaattgacctgcgcttaccagcagacgtgaactttattgtgcagccgctgtgggggtctattggttatactttagctgcggccttcggagcgcagacagcgtgtccaaaccgtcgtgtgatcgtattgacaggagatggagcagcgcagttgaccattcaggagttaggctcgatgttacgcgataagcagcaccccattatcctggtcctgaacaatgaggggtatacagttgaacgcgccattcatggtgcggaacaacgctacaatgacatcgctttatggaattggacgcacatcccccaagccttatcgttagatccccaatcggaatgttggcgtgtgtctgaagcagagcaactggctgatgttctggaaaaagttgctcatcatgaacgcctgtcgttgatcgaggtaatgttgcccaaggccgatatccctccgttactgggagccttgaccaaggctttagaagcctgcaacaacgcttaa

SEQ ID NO: 261 - DNA, 1509 bp, Artificial Sequence
  Description of Artificial Sequence: Synthetic polynucleotide
gaaggagatatacatatgcccaccttgaacttggacttacccaacggtattaagagcacgattcaggcagaccttttcatcaataataagtttgtgccggcgcttgatgggaaaacgttcgcaactattaatccgtctacggggaaagagatcggacaggtggcagaggcttcggcgaaggatgtggatcttgcagttaaggccgcgcgtgaggcgtttgaaactacttggggggaaaacacgccaggtgatgctcgtggccgtttactgattaagcttgctgagttggtggaagcgaatattgatgagttagcggcaattgaatcactggacaatgggaaagcgttctctattgctaagtcattcgacgtagctgctgtggccgcaaacttacgttactacggcggttgggctgataaaaaccacggtaaagtcatggaggtagacacaaagcgcctgaactatacccgccacgagccgatcggggtttgcggacaaatcattccgtggaatttcccgcttttgatgtttgcatggaagctgggtcccgctttagccacagggaacacaattgtgttaaagactgccgagcagactcccttaagtgctatcaagatgtgtgaattaatcgtagaagccggctttccgcccggagtagttaatgtgatctcgggattcggaccggtggcgggggccgcgatctcgcaacacatggacatcgataagattgcctttacaggatcgacattggttggccgcaacattatgaaggcagctgcgtcgactaacttaaaaaaggttacacttgagttaggaggaaaatccccgaatatcattttcaaagatgccgaccttgaccaagctgttcgctggagcgccttcggtatcatgtttaaccacggacaatgctgctgcgctggatcgcgcgtatatgtggaagaatccatctatgacgccttcatggaaaaaatgactgcgcattgtaaggcgcttcaagttggagatcctttcagcgcgaacaccttccaaggaccacaagtctcgcagttacaatacgaccgtatcatggaatacatcgaatcagggaaaaaagatgcaaatcttgctttaggcggcgttcgcaaagggaatgaggggtatttcattgagccaactatttttacagacgtgccgcacgacgcgaagattgccaaagaggagatcttcggtccagtggttgttgtgtcgaaatttaaggacgaaaaagatctgatccgtatcgcaaatgattctatttatggtttagctgcggcagtcttttcccgcgacatcagccgcgcgatcgagacagcacacaaactgaaagcaggcacggtctgggtcaactgctataatcagcttattccgcaggtgccattcggagggtataaggcttccggtatcggccgtgagttgggggaatatgccttgtctaattacacaaatatcaaggccgtccacgttaacctttctcaaccggcgcccatttga

SEQ ID NO: 262 - DNA, 6573 bp, Artificial Sequence
  Description of Artificial Sequence: Synthetic polynucleotide
ctctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagtta

SEQ ID NO: 263 - DNA, 1562 bp, Artificial Sequence; identical to SEQ ID NO: 74
  Description of Artificial Sequence: Synthetic polynucleotide

SEQ ID NO: 264 - DNA, 1596 bp, Artificial Sequence; identical to SEQ ID NO: 76
  Description of Artificial Sequence: Synthetic polynucleotide

SEQ ID NO: 265 - DNA, 1359 bp, Artificial Sequence; identical to SEQ ID NO: 78
  Description of Artificial Sequence: Synthetic polynucleotide

SEQ ID NO: 266 - DNA, 1193 bp, Artificial Sequence
  Description of Artificial Sequence: Synthetic polynucleotide
atgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctg

SEQ ID NO: 267 - DNA, 807 bp, Artificial Sequence; identical to SEQ ID NO: 82
  Description of Artificial Sequence: Synthetic polynucleotide

SEQ ID NO: 268 - DNA, 6574 bp, Artificial Sequence
  Description of Artificial Sequence: Synthetic polynucleotide
ctctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaattcgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 269 - DNA, 1562 bp, Artificial Sequence
  Description of Artificial Sequence: Synthetic polynucleotide
atgcaaacacaaaaaccgactctcgaactgctaacctgcgaaggcgcttatcgcgacaacccgactgcgctttttcaccagttgtgtggggatcgtccggcaacgctgctgctggaattcgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 270 - DNA, 7615 bp, Artificial Sequence
  Description of Artificial Sequence: Synthetic polynucleotide
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatgctgttattcgagactgtgcgtgaaatgggtcatgagcaagtccttttctgtcatagcaagaatcccgagatcaaggcaattatcgcaatccacgataccaccttaggaccggctatgggcgcaactcgtatcttaccttatattaatgaggaggctgccctgaaagatgcattacgtctgtcccgcggaatgacttacaaagcagcctgcgccaatattcccgccgggggcggcaaagccgtcatcatcgctaaccccgaaaacaagaccgatgacctgttacgcgcatacggccgtttcgtggacagcttgaacggccgtttcatcaccgggcaggacgttaacattacgcccgacgacgttcgcactatttcgcaggagactaagtacgtggtaggcgtctcagaaaagtcgggagggccggcacctatcacctctctgggagtatttttaggcatcaaagccgctgtagagtcgcgttggcagtctaaacgcctggatggcatgaaagtggcggtgcaaggacttgggaacgtaggaaaaaatctttgtcgccatctgcatgaacacgatgtacaactttttgtgtctgatgtcgatccaatcaaggccgaggaagtaaaacgcttattcggggcgactgttgtcgaaccgactgaaatctattctttagatgttgatatttttgcaccgtgtgcacttgggggtattttgaatagccataccatcccgttcttacaagcctcaatcatcgcaggagcagcgaataaccagctggagaacgagcaacttcattcgcagatgcttgcgaaaaagggtattctttactcaccagactacgttatcaatgcaggaggacttatcaatgtttataacgaaatgatcggatatgacgaggaaaaagcattcaaacaagttcataacatctacgatacgttattagcgattttcgaaattgcaaaagaacaaggtgtaaccaccaacgacgcggcccgtcgtttagcagaggatcgtatcaacaactccaaacgctcaaagagtaaagcgattgcggcgtgaaatgtaagaaggagatatacatatggaaaacaacaccaatatgttctctggagtgaaggtgatcgaactggccaactttatcgctgctccggcggcaggtcgcttctttgctgatgggggagcagaagtaattaagatcgaatctccagcaggcgacccgctgcgctacacggccccatcagaaggacgcccgctttctcaagaggaaaacacaacgtatgatttggaaaacgcgaataagaaagcaattgttctgaacttaaaatcggaaaaaggaaagaaaattcttcacgagatgcttgctgaggcagacatcttgttaacaaattggcgcacgaaagcgttagtcaaacaggggttagattacgaaacactgaaagagaagtatccaaaattggtatttgcacagattacaggatacggggagaaaggacccgacaaagacctgcctggtttcgactacacggcgtttttcgcccgcggaggagtctccggtacattatatgaaaaaggaactgtccctcctaatgtggtaccgggtctgggtgaccaccaggcaggaatgttcttagctgccggtatggctggtgcgttgtataaggccaaaaccaccggacaaggcgacaaagtcaccgttagtctgatgcatagcgcaatgtacggcctgggaatcatgattcaggcagcccagtacaaggaccatgggctggtgtacccgatcaaccgtaatgaaacgcctaatcctttcatcgtttcatacaagtccaaagatgattactttgtccaagtttgcatgcctccctatgatgtgttttatgatcgctttatgacggccttaggacgtgaagacttggtaggtgacgaacgctacaataagatcgagaacttgaaggatggtcgcgcaaaagaagtctattccatcatcgaacaacaaatggtaacgaagacgaaggacgaatgggacaagatttttcgtgatgcagacattccattcgctattgcccaaacgtgggaagatcttttagaagacgagcaggcatgggccaacgactacctgtataaaatgaagtatcccacaggcaacgaacgtgccctggtacgtttacctgtgttcttcaaagaagctggacttcctgaatacaaccagtcgccacagattgctgagaataccgtggaagtgttaaaggagatgggatataccgagcaagaaattgaggagcttgagaaagacaaagacatcatggtacgtaaagagaaatgaaggttaagaaggagatatacatatgtcagaccgcaacaaagaagtgaaagaaaagaaggctaaacactatctgcgcgagatcacagctaaacactacaaggaagcgttagaggctaaagagcgtggggagaaagtgggttggtgtgcctctaacttcccccaagagattgcaaccacgttgggtgtaaaggttgtttatcccgaaaaccacgccgccgccgtagcggcacgtggcaatgggcaaaatatgtgcgaacacgcggaggctatgggattcagtaatgatgtgtgtggatatgcacgtgtaaatttagccgtaatggacatcggccatagtgaagatcaacctattccaatgcctgatttcgttctgtgctgtaataatatctgcaatcagatgattaaatggtatgaacacattgcaaaaacgttggatattcctatgatccttatcgatattccatataatactgagaacacggtgtctcaggaccgcattaagtacatccgcgcccagttcgatgacgctatcaagcaactggaagaaatcactggcaaaaagtgggacgagaataaattcgaagaagtgatgaagatttcgcaagaatcggccaagcaatggttacgcgccgcgagctacgcgaaatacaaaccatcaccgttttcgggctttgacctttttaatcacatggctgtagccgtttgtgctcgcggcacccaggaagccgccgatgcattcaaaatgttagcagatgaatatgaagagaacgttaagacaggaaagtctacttatcgcggcgaggagaagcagcgtatcttgttcgagggcatcgcttgttggccttatctgcgccacaagttgacgaaactgagtgaatatggaatgaacgtcacagctacggtgtacgccgaagcttttggggttatttacgaaaacatggatgaactgatggccgcttacaataaagtgcctaactcaatctccttcgagaacgcgctgaagatgcgtcttaatgccgttacaagcaccaatacagaaggggctgttatccacattaatcgcagttgtaagctgtggtcaggattcttatacgaactggcccgtcgtttggaaaaggagacggggatccctgttgtttcgttcgacggagatcaagcggatccccgtaacttctccgaggctcaatatgacactcgcatccaaggtttaaatgaggtgatggtcgcgaaaaaagaagcagagtgagctttaagaaggagatatacatatgtcgaatagtgacaagttttttaacgacttcaaggacattgtggaaaacccaaagaagtatatcatgaagcatatggaacaaacgggacaaaaagccatcggttgcatgcctttatacaccccagaagagcttgtcttagcggcgggtatgtttcctgttggagtatggggctcgaatactgagttgtcaaaagccaagacctactttccggcttttatctgttctatcttgcaaactactttagaaaacgcattgaatggggagtatgacatgctgtctggtatgatgatcacaaactattgcgattcgctgaaatgtatgggacaaaacttcaaacttacagtggaaaatatcgaattcatcccggttacggttccacaaaaccgcaagatggaggcgggtaaagaatttctgaaatcccagtataaaatgaatatcgaacaactggaaaaaatctcagggaataagatcactgacgagagcttggagaaggctattgaaatttacgatgagcaccgtaaagtcatgaacgatttctctatgcttgcgtccaagtaccctggtatcattacgccaacgaaacgtaactacgtgatgaagtcagcgtattatatggacaagaaagaacatacagagaaggtacgtcagttgatggatgaaatcaaggccattgagcctaaaccattcgaaggaaaacgcgtgattaccactgggatcattgcagattcggaggaccttttgaaaatcttggaggagaataacattgctatcgtgggagatgatattgcacacgagtctcgccaataccgcactttgaccccggaggccaacacacctatggaccgtcttgctgaacaatttgcgaaccgcgagtgttcgacgttgtatgaccctgaaaaaaaacgtggacagtatattgtcgagatggcaaaagagcgtaaggccgacggaatcatcttcttcatgacaaaattctgcgatcccgaagaatacgattaccctcagatgaaaaaagacttcgaagaagccggtattccccacgttctgattgagacagacatgcaaatgaagaactacgaacaagctcgcaccgctattcaagcattttcagaaaccctttgacgcttaagaaggagatatacatatgcgtgctgtcttaatcgagaagtcagatgacacccagagtgtttcagttacggagttggctgaagaccaattacccgaaggtgacgtccttgtggatgtcgcgtacagcacattgaattacaaggatgctcttgcgattactggaaaagcacccgttgtacgccgttttcctatggtccccggaattgactttactgggactgtcgcacagagttcccatgctgatttcaagccaggcgaccgcgtaattctgaacggatggggagttggtgagaaacactggggcggtcttgcagaacgcgcacgcgtacgtggggactggcttgtcccgttgccagcccccttagacttgcgccaggctgcaatgattggcactgcggggtacacagctatgctgtgcgtgcttgcccttgagcgccatggagtcgtacctgggaacggcgagattgtcgtctcaggcgcagcaggaggggtaggttctgtagcaaccacactgttagcagccaaaggctacgaagtggccgccgtgaccgggcgcgcaagcgaggccgaatatttacgcggattaggcgccgcgtcggtcattgatcgcaatgaattaacggggaaggtgcgtccattagggcaggaacgctgggcaggaggaatcgatgtagcaggatcaaccgtacttgctaatatgttgagcatgatgaaataccgtggcgtggtggcggcctgtggcctggcggctggaatggacttgcccgcgtctgtcgccccttttattctgcgtggtatgactttggcaggggtagattcagtcatgtgccccaaaactgatcgtctggctgcttgggcacgcctggcatccgacctggaccctgcaaagctggaagagatgacaactgaattaccgttctctgaggtgattgaaacggctccgaagttcttggatggaacagtgcgtgggcgtattgtcattccggtaacaccttgatacttaagaaggagatatacatatgaaaatcttggcatactgcgtccgcccagacgaggtagactcctttaagaaatttagtgaaaagtacgggcatacagttgatcttattccagactcttttggacctaatgtcgctcatttggcgaagggttacgatgggatttctattctgggcaacgacacgtgtaaccgtgaggcactggagaagatcaaggattgcgggatcaaatatctggcaacccgtacagccggagtgaacaacattgacttcgatgcagcaaaggagttcggtattaacgtggctaatgttcccgcatattcccccaactcggtcagcgaatttaccattggattggcattaagtctgacgcgtaagattccatttgccctgaaacgcgtggaactgaacaattttgcgcttggcggccttattggtgtggaattgcgtaacttaactttaggagtcatcggtactggtcgcatcggattgaaagtgattgagggcttctctgggtttggaatgaaaaaaatgatcggttatgacatttttgaaaatgaagaagcaaagaagtacatcgaatacaaatcattagacgaagtttttaaagaggctgatattatcactctgcatgcgcctctgacagacgacaactatcatatgattggtaaagaatccattgctaaaatgaaggatggggtatttattatcaacgcagcgcgtggagccttaatcgatagtgaggccctgattgaagggttaaaatcggggaagatt

SEQ ID NO: 271 - DNA, 1239 bp, Artificial Sequence
  Description of Artificial Sequence: Synthetic polynucleotide
atggaaaacaacaccaatatgttctctggagtgaaggtgatcgaactggccaactttatcgctgctccggcggcaggtcgcttctttgctgatgggggagcagaagtaattaagatcgaatctccagcaggcgacccgctgcgctacacggccccatcagaaggacgcccgctttctcaagaggaaaacacaacgtatgatttggaaaacgcgaataagaaagcaattgttctgaacttaaaatcggaaaaaggaaagaaaattcttcacgagatgcttgctgaggcagacatcttgttaacaaattggcgcacgaaagcgttagtcaaacaggggttagattacgaaacactgaaagagaagtatccaaaattggtatttgcacagattacaggatacggggagaaaggacccgacaaagacctgcctggtttcgactacacggcgtttttcgcccgcggaggagtctccggtacattatatgaaaaaggaactgtccctcctaatgtggtaccgggtctgggtgaccaccaggcaggaatgttcttagctgccggtatggctggtgcgttgtataaggccaaaaccaccggacaaggcgacaaagtcaccgttagtctgatgcatagcgcaatgtacggcctgggaatcatgattcaggcagcccagtacaaggaccatgggctggtgtacccgatcaaccgtaatgaaacgcctaatcctttcatcgtttcatacaagtccaaagatgattactttgtccaagtttgcatgcctccctatgatgtgttttatgatcgctttatgacggccttaggacgtgaagacttggtaggtgacgaacgctacaataagatcgagaacttgaaggatggtcgcgcaaaagaagtctattccatcatcgaacaacaaatggtaacgaagacgaaggacgaatgggacaagatttttcgtgatgcagacattccattcgctattgcccaaacgtgggaagatcttttagaagacgagcaggcatgggccaacgactacctgtataaaatgaagtatcccacaggcaacgaacgtgccctggtacgtttacctgtgttcttcaaagaagctggacttcctgaatacaaccagtcgccacagattgctgagaataccgtggaagtgttaaaggagatgggatataccgagcaagaaattgaggagcttgagaaagacaaagacatcatggtacgtaaagagaaatga

SEQ ID NO: 272-277 - skipped (6 entries)

SEQ ID NO: 278 - DNA, 1224 bp, Artificial Sequence
  Description of Artificial Sequence: Synthetic polynucleotide
atgtcagaccgcaacaaagaagtgaaagaaaagaaggctaaacactatctgcgcgagatcacagctaaacactacaaggaagcgttagaggctaaagagcgtggggagaaagtgggttggtgtgcctctaacttcccccaagagattgcaaccacgttgggtgtaaaggttgtttatcccgaaaaccacgccgccgccgtagcggcacgtggcaatgggcaaaatatgtgcgaacacgcggaggctatgggattcagtaatgatgtgtgtggatatgcacgtgtaaatttagccgtaatggacatcggccatagtgaagatcaacctattccaatgcctgatttcgttctgtgctgtaataatatctgcaatcagatgattaaatggtatgaacacattgcaaaaacgttggatattcctatgatccttatcgatattccatataatactgagaacacggtgtctcaggaccgcattaagtacatccgcgcccagttcgatgacgctatcaagcaactggaagaaatcactggcaaaaagtgggacgagaataaattcgaagaagtgatgaagatttcgcaagaatcggccaagcaatggttacgcgccgcgagctacgcgaaatacaaaccatcaccgttttcgggctttgacctttttaatcacatggctgtagccgtttgtgctcgcggcacccaggaagccgccgatgcattcaaaatgttagcagatgaatatgaagagaacgttaagacaggaaagtctacttatcgcggcgaggagaagcagcgtatcttgttcgagggcatcgcttgttggccttatctgcgccacaagttgacgaaactgagtgaatatggaatgaacgtcacagctacggtgtacgccgaagcttttggggttatttacgaaaacatggatgaactgatggccgcttacaataaagtgcctaactcaatctccttcgagaacgcgctgaagatgcgtcttaatgccgttacaagcaccaatacagaaggggctgttatccacattaatcgcagttgtaagctgtggtcaggattcttatacgaactggcccgtcgtttggaaaaggagacggggatccctgttgtttcgttcgacggagatcaagcggatccccgtaacttctccgaggctcaatatgacactcgcatccaaggtttaaatgaggtgatggtcgcgaaaaaagaagcagagtga

SEQ ID NO: 279 - DNA, 1124 bp, Artificial Sequence
  Description of Artificial Sequence: Synthetic polynucleotide
atgtcgaatagtgacaagttttttaacgacttcaaggacattgtggaaaacccaaagaagtatatcatgaagcatatggaacaaacgggacaaaaagccatcggttgcatgcctttatacaccccagaagagcttgtcttagcggcgggtatgtttcctgttggagtatggggctcgaatactgagttgtcaaaagccaagacctactttccggcttttatctgttctatcttgcaaactactttagaaaacgcattgaatggggagtatgacatgctgtctggtatgatgatcacaaactattgcgattcgctgaaatgtatgggacaaaacttcaaacttacagtggaaaatatcgaattcatcccggttacggttccacaaaaccgcaagatggaggcgggtaaagaatttctgaaatcccagtataaaatgaatatcgaacaactggaaaaaatctcagggaataagatcactgacgagagcttggagaaggctattgaaatttacgatgagcaccgtaaagtcatgaacgatttctctatgcttgcgtccaagtaccctggtatcattacgccaacgaaacgtaactacgtgatgaagtcagcgtattatatggacaagaaagaacatacagagaaggtacgtcagttgatggatgaaatcaaggccattgagcctaaaccattcgaaggaaaacgcgtgattaccactgggatcattgcagattcggaggaccttttgaaaatcttggaggagaataacattgctatcgtgggagatgatattgcacacgagtctcgccaataccgcactttgaccccggaggccaacacacctatggaccgtcttgctgaacaatttgcgaaccgcgagtgttcgacgttgtatgaccctgaaaaaaaacgtggacagtatattgtcgagatggcaaaagagcgtaaggccgacggaatcatcttcttcatgacaaaattctgcgatcccgaagaatacgattaccctcagatgaaaaaagacttcgaagaagccggtattccccacgttctgattgagacagacatgcaaatgaagaactacgaacaagctcgcaccgctattcaagcattttcagaaaccctttg

SEQ ID NO: 280 - DNA, 981 bp, Artificial Sequence
  Description of Artificial Sequence: Synthetic polynucleotide
atgcgtgctgtcttaatcgagaagtcagatgacacccagagtgtttcagttacggagttggctgaagaccaattacccgaaggtgacgtccttgtggatgtcgcgtacagcacattgaattacaaggatgctcttgcgattactggaaaagcacccgttgtacgccgttttcctatggtccccggaattgactttactgggactgtcgcacagagttcccatgctgatttcaagccaggcgaccgcgtaattctgaacggatggggagttggtgagaaacactggggcggtcttgcagaacgcgcacgcgtacgtggggactggcttgtcccgttgccagcccccttagacttgcgccaggctgcaatgattggcactgcggggtacacagctatgctgtgcgtgcttgcccttgagcgccatggagtcgtacctgggaacggcgagattgtcgtctcaggcgcagcaggaggggtaggttctgtagcaaccacactgttagcagccaaaggctacgaagtggccgccgtgaccgggcgcgcaagcgaggccgaatatttacgcggattaggcgccgcgtcggtcattgatcgcaatgaattaacggggaaggtgcgtccattagggcaggaacgctgggcaggaggaatcgatgtagcaggatcaaccgtacttgctaatatgttgagcatgatgaaataccgtggcgtggtggcggcctgtggcctggcggctggaatggacttgcccgcgtctgtcgccccttttattctgcgtggtatgactttggcaggggtagattcagtcatgtgccccaaaactgatcgtctggctgcttgggcacgcctggcatccgacctggaccctgcaaagctggaagagatgacaactgaattaccgttctctgaggtgattgaaacggctccgaagttcttggatggaacagtgcgtgggcgtattgtcattccggtaacaccttga

SEQ ID NO: 281 - DNA, 996 bp, Artificial Sequence
  Description of Artificial Sequence: Synthetic polynucleotide
atgaaaatcttggcatactgcgtccgcccagacgaggtagactcctttaagaaatttagtgaaaagtacgggcatacagttgatcttattccagactcttttggacctaatgtcgctcatttggcgaagggttacgatgggatttctattctgggcaacgacacgtgtaaccgtgaggcactggagaagatcaaggattgcgggatcaaatatctggcaacccgtacagccggagtgaacaacattgacttcgatgcagcaaaggagttcggtattaacgtggctaatgttcccgcatattcccccaactcggtcagcgaatttaccattggattggcattaagtctgacgcgtaagattccatttgccctgaaacgcgtggaactgaacaattttgcgcttggcggccttattggtgtggaattgcgtaacttaactttaggagtcatcggtactggtcgcatcggattgaaagtgattgagggcttctctgggtttggaatgaaaaaaatgatcggttatgacatttttgaaaatgaagaagcaaagaagtacatcgaatacaaatcattagacgaagtttttaaagaggctgatattatcactctgcatgcgcctctgacagacgacaactatcatatgattggtaaagaatccattgctaaaatgaaggatggggtatttattatcaacgcagcgcgtggagccttaatcgatagtgaggccctgattgaagggttaaaatcggggaagattgcgggcgcggctctggatagctatgagtatgagcaaggtgtctttcacaacaataagatgaatgaaattatgcaggatgataccttggaacgtctgaaatcttttcccaacgtcgtgatcacgccgcatttgggtttttatactgatgaggcggtttccaatatggtagagatcacactgatgaaccttcaggaattcgagttgaaaggaacctgtaagaaccagcgtgtttgtaaatga

SEQ ID NO: 282 - DNA, 8008 bp, Artificial Sequence
  Description of Artificial Sequence: Synthetic polynucleotide
ctctagaaataattttgtttaactttaagaaggagatatacatatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctgacgctgcgtgaagagctgcaagatgagctggaaatcgtgatgcgcgtctattttgaaaagccgcgtactacggtgggctggaaagggctgattaacgatccgcatatggataacagcttccagatcaacgacggtctgcgtattgcccgcaaattgctgctcgatattaacgacagcggtctgccagcggcgggtgaattcctggatatgatcaccctacaatatctcgctgacctgatgagctggggcgcaattggcgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcgcaggtgatgatcgatttcagccatgctaactcgtcaaaacaattcaaaaagcagatggatgtttgtactgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgagtgcagtaaaagcgcgtcgcgggtaatacttaagaaggagatatacatatgctgttattcgagactgtgcgtgaaatgggtcatgagcaagtccttttctgtcatagcaagaatcccgagatcaaggcaattatcgcaatccacgataccaccttaggaccggctatgggcgcaactcgtatcttaccttatattaatgaggaggctgccctgaaagatgcattacgtctgtcccgcggaatgacttacaaagcagcctgcgccaatattcccgccgggggcggcaaagccgtcatcatcgctaaccccgaaaacaagaccgatgacctgttacgcgcatacggccgtttcgtggacagcttgaacggccgtttcatcaccgggcaggacgttaacattacgcccgacgacgttcgcactatttcgcaggagactaagtacgtggtaggcgtctcagaaaagtcgggagggccggcacctatcacctctctgggagtatttttaggcatcaaagccgctgtagagtcgcgttggcagtctaaacgcctggatggcatgaaagtggcggtgcaaggacttgggaacgtaggaaaaaatctttgtcgccatctgcatgaacacgatgtacaactttttgtgtctgatgtcgatccaatcaaggccgaggaagtaaaacgcttattcggggcgactgttgtcgaaccgactgaaatctattctttagatgttgatatttttgcaccgtgtgcacttgggggtattttgaatagccataccatcccgttcttacaagcctcaatcatcgcaggagcagcgaataaccagctggagaacgagcaacttcattcgcagatgcttgcgaaaaagggtattctttactcaccagactacgttatcaatgcaggaggacttatcaatgtttataacgaaatgatcggatatgacgaggaaaaagcattcaaacaagttcataacatctacgatacgttattagcgattttcgaaattgcaaaagaacaaggtgtaaccaccaacgacgcggcccgtcgtttagcagaggatcgtatcaacaactccaaacgctcaaagagtaaagcgattgcggcgtgaaatgtaagaaggagatatacatatggaaaacaacaccaatatgttctctggagtgaaggtgatcgaactggccaactttatcgctgctccggcggcaggtcgcttctttgctgatgggggagcagaagtaattaagatcgaatctccagcaggcgacccgctgcgctacacggccccatcagaaggacgcccgctttctcaagaggaaaacacaacgtatgatttggaaaacgcgaataagaaagcaattgttctgaacttaaaatcggaaaaaggaaagaaaattcttcacgagatgcttgctgaggcagacatcttgttaacaaattggcgcacgaaagcgttagtcaaacaggggttagattacgaaacactgaaagagaagtatccaaaattggtatttgcacagattacaggatacggggagaaaggacccgacaaagacctgcctggtttcgactacacggcgtttttcgcccgcggaggagtctccggtacattatatgaaaaaggaactgtccctcctaatgtggtaccgggtctgggtgaccaccaggcaggaatgttcttagctgccggtatggctggtgcgttgtataaggccaaaaccaccggacaaggcgacaaagtcaccgttagtctgatgcatagcgcaatgtacggcctgggaatcatgattcaggcagcccagtacaaggaccatgggctggtgtacccgatcaaccgtaatgaaacgcctaatcctttcatcgtttcatacaagtccaaagatgattactttgtccaagtttgcatgcctccctatgatgtgttttatgatcgctttatgacggccttaggacgtgaagacttggtaggtgacgaacgctacaataagatcgagaacttgaaggatggtcgcgcaaaagaagtctattccatcatcgaacaacaaatggtaacgaagacgaaggacgaatgggacaagatttttcgtgatgcagacattccattcgctattgcccaaacgtgggaagatcttttagaagacgagcaggcatgggccaacgactacctgtataaaatgaagtatcccacaggcaacgaacgtgccctggtacgtttacctgtgttcttcaaagaagctggacttcctgaatacaaccagtcgccacagattgctgagaataccgtggaagtgttaaaggagatgggatataccgagcaagaaattgaggagcttgagaaagacaaagacatcatggtacgtaaagagaaatgaaggttaagaaggagatatacatatgtcagaccgcaacaaagaagtgaaagaaaagaaggctaaacactatctgcgcgagatcacagctaaacactacaaggaagcgttagaggctaaagagcgtggggagaaagtgggttggtgtgcctctaacttcccccaagagattgcaaccacgttgggtgtaaaggttgtttatcccgaaaaccacgccgccgccgtagcggcacgtggcaatgggcaaaatatgtgcgaacacgcggaggctatgggattcagtaatgatgtgtgtggatatgcacgtgtaaatttagccgtaatggacatcggccatagtgaagatcaacctattccaatgcctgatttcgttctgtgctgtaataatatctgcaatcagatgattaaatggtatgaacacattgcaaaaacgttggatattcctatgatccttatcgatattccatataatactgagaacacggtgtctcaggaccgcattaagtacatccgcgcccagttcgatgacgctatcaagcaactggaagaaatcactggcaaaaagtgggacgagaataaattcgaagaagtgatgaagatttcgcaagaatcggccaagcaatggttacgcgccgcgagctacgcgaaatacaaaccatcaccgttttcgggctttgacctttttaatcacatggctgtagccgtttgtgctcgcggcacccaggaagccgccgatgcattcaaaatgttagcagatgaatatgaagagaacgttaagacaggaaagtctacttatcgcggcgaggagaagcagcgtatcttgttcgagggcatcgcttgttggccttatctgcgccacaagttgacgaaactgagtgaatatggaatgaacgtcacagctacggtgtacgccgaagcttttggggttatttacgaaaacatggatgaactgatggccgcttacaataaagtgcctaactcaatctccttcgagaacgcgctgaagatgcgtcttaatgccgttacaagcaccaatacagaaggggctgttatccacattaatcgcagttgtaagctgtggtcaggattcttatacgaactggcccgtcgtttggaaaaggagacggggatccctgttgtttcgttcgacggagatcaagcggatccccgtaacttctccgaggctcaatatgacactcgcatccaaggtttaaatgaggtgatggtcgcgaaaaaagaagcagagtgagctttaagaaggagatatacatatgtcgaatagtgacaagttttttaacgacttcaaggacattgtggaaaacccaaagaagtatatcatgaagcatatggaacaaacgggacaaaaagccatcggttgcatgcctttatacaccccagaagagcttgtcttagcggcgggtatgtttcctgttggagtatggggctcgaatactgagttgtcaaaagccaagacctactttccggcttttatctgttctatcttgcaaactactttagaaaacgcattgaatggggagtatgacatgctgtctggtatgatgatcacaaactattgcgattcgctgaaatgtatgggacaaaacttcaaacttacagtggaaaatatcgaattcatcccggttacggttccacaaaaccgcaagatggaggcgggtaaagaatttctgaaatcccagtataaaatgaatatcgaacaactggaaaaaatctcagggaataagatcactgacgagagcttggagaaggctattgaaatttacgatgagcaccgtaaagtcatgaacgatttctctatgcttgcgtccaagtaccctggtatcattacgccaacgaaacgtaactacgtgatgaagtcagcgtattatatggacaagaaagaacatacagagaaggtacgtcagttgatggatgaaatcaaggccattgagcctaaaccattcgaaggaaaacgcgtgattaccactgggatcattgcagattcggaggaccttttgaaaatcttggaggagaataacattgctatcgtgggagatgatattgcacacgagtctcgccaataccgcactttgaccccggaggccaacacacctatggaccgtcttgctgaacaatttgcgaaccgcgagtgttcgacgttgtatgaccctgaaaaaaaacgtggacagtatattgtcgagatggcaaaagagcgtaaggccgacggaatcatcttcttcatgacaaaattctgcgatcccgaagaatacgattaccctcagatgaaaaaagacttcgaagaagccggtattccccacgttctgattgagacagacatgcaaatgaagaactacgaacaagctcgcaccgctattcaagcattttcagaaaccctttgacgcttaagaaggagatatacatatgttctttacggagcaacacgaacttattcgcaaactggcgcgtgactttgccgaacaggaaatcgagcctatcgcagacgaagtagataaaaccgcagagttcccaaaagaaatcgtgaagaagatggctcaaaatggatttttcggcattaaaatgcctaaagaatacggaggggcgggtgcggataaccgcgcttatgtcactattatggaggaaatttcacgtgcttccggggtagcgggtatctacctgagctcgccgaacagtttgttaggaactcccttcttattggtcggaaccgatgagcaaaaagaaaagtaccttaagcctatgatccgcggcgagaagactctggcgttcgccctgacagagcctggtgctggctctgatgcgggtgcgttggctactactgcccgtgaagagggcgactattatatcttaaatggccgcaagacgtttattacaggggctcctattagcgacaatattattgtgttcgcaaaaaccgatatgagcaaagggaccaaaggtatcaccactttcattgtggactcaaagcaggaaggggtaagttttggtaagccagaggacaaaatgggaatgattggttgtccgacaagcgacatcatcttggaaaacgttaaagttcataagtccgacatcttgggagaagtcaataaggggtttattaccgcgatgaaaacactttccgttggtcgtatcggagtggcgtcacaggcgcttggaattgcacaggccgccgtagatgaggcggtaaagtacgccaagcaacgtaaacaattcaatcgcccaatcgcgaaatttcaggccattcaatttaaacttgccaatatggagactaaattaaatgccgctaaacttcttgtttataacgcagcgtacaaaatggattgtggagaaaaagccgacaaggaagcctctatggctaaatactttgctgctgaatcagcgatccaaatcgttaacgacgcgctgcaaatccatggcgggtatggctatatcaaagactacaagattgaacgtttgtaccgcgatgtgcgtgtgatcgctatttatgagggcacttccgaggtccaacagatggttatcgcgtccaatctgctgaagtaatacttaagaaggagatatacatatgaaaatcttggcatactgcgtccgcccagacgaggtagactcctttaagaaatttagtgaaaagtacgggcatacagttgatcttattccagactcttttggacctaatgtcgctcatttggcgaagggttacgatgggatttctattctgggcaacgacacgtgtaaccgtgaggcactggagaagatcaaggattgcgggatcaaatatctggcaacccgtacagccggagtgaacaacattgacttcgatgcagcaaaggagttcggtattaacgtggctaatgttcccgcatattcccccaactcggtcagcgaatttaccattggattggcattaagtctgacgcgtaagattccatttgccctgaaacgcgtggaactgaacaattttgcgcttggcggccttattggtgtggaattgcgtaacttaactttaggagtcatcggtactggtcgcatcggattgaaagtgattgagggcttctctgggtttggaatgaaaaaaatgatcggttatgacatttttgaaaatgaagaagcaaagaagtacatcgaatacaaatcattagacgaagtttttaaagaggctgatattatcactctgcatgcgcctctgacagacgacaactatcatatgattggtaaagaatccattgctaaaatgaaggatggggtatttattatcaacgcagcgcgtggagccttaatcgatagtgaggccctgattgaagggttaaaatcggggaagattgcgggcgcggctctggatagctatgagtatgagcaaggtgtctttcacaacaataagatgaatgaaattatgcaggatgataccttggaacgtctgaaatcttttcccaacgtcgtgatcacgccgcatttgggtttttatactgatgaggcggtttccaatatggtagagatcacactgatgaaccttcaggaattcgagttgaaaggaacctgtaagaaccagcgtgtttgtaaatga

SEQ ID NO: 283 - DNA, 1134 bp, Artificial Sequence
  Description of Artificial Sequence: Synthetic polynucleotide
atgttctttacggagcaacacgaacttattcgcaaactggcgcgtgactttgccgaacaggaaatcgagcctatcgcagacgaagtagataaaaccgcagagttcccaaaagaaatcgtgaagaagatggctcaaaatggatttttcggcattaaaatgcctaaagaatacggaggggcgggtgcggataaccgcgcttatgtcactattatggaggaaatttcacgtgcttccggggtagcgggtatctacctgagctcgccgaacagtttgttaggaactcccttcttattggtcggaaccgatgagcaaaaagaaaagtaccttaagcctatgatccgcggcgagaagactctggcgttcgccctgacagagcctggtgctggctctgatgcgggtgcgttggctactactgcccgtgaagagggcgactattatatcttaaatggccgcaagacgtttattacaggggctcctattagcgacaatattattgtgttcgcaaaaaccgatatgagcaaagggaccaaaggtatcaccactttcattgtggactcaaagcaggaaggggtaagttttggtaagccagaggacaaaatgggaatgattggttgtccgacaagcgacatcatcttggaaaacgttaaagttcataagtccgacatcttgggagaagtcaataaggggtttattaccgcgatgaaaacactttccgttggtcgtatcggagtggcgtcacaggcgcttggaattgcacaggccgccgtagatgaggcggtaaagtacgccaagcaacgtaaacaattcaatcgcccaatcgcgaaatttcaggccattcaatttaaacttgccaatatggagactaaattaaatgccgctaaacttcttgtttataacgcagcgtacaaaatggattgtggagaaaaagccgacaaggaagcctctatggctaaatactttgctgctgaatcagcgatccaaatcgttaacgacgcgctgcaaatccatggcgggtatggctatatcaaagactacaagattgaacgtttgtaccgcgatgtgcgtgtgatcgctatttatgagggcacttccgaggtccaacagatggttatcgcgtccaatctgctgaagtaa

SEQ ID NO: 284 - protein, 5 aa, Artificial Sequence
  Description of Artificial Sequence: Synthetic peptide
GGGGS

SEQ ID NO: 285 - protein, 18 aa, Artificial Sequence
  Description of Artificial Sequence: Synthetic peptide
KESGSVSSEQLAQFRSLD

SEQ ID NO: 286 - protein, 14 aa, Artificial Sequence
  Description of Artificial Sequence: Synthetic peptide
EGKSSGSGSESKST

SEQ ID NO: 287 - protein, 8 aa, Artificial Sequence
  Description of Artificial Sequence: Synthetic peptide
GGGGGGGG

SEQ ID NO: 288 - protein, 12 aa, Artificial Sequence
  Description of Artificial Sequence: Synthetic peptide
GSAGSAAGSGEF

SEQ ID NO: 289 - DNA, 18 bp, Artificial Sequence
  Description of Artificial Sequence: Synthetic oligonucleotide
ttgttgayryrtcaacwa

SEQ ID NO: 290 - DNA, 15 bp, Artificial Sequence
  Description of Artificial Sequence: Synthetic oligonucleotide
  modified_base (8)..(8): a, c, t, g, unknown or other
ttataatnattataa

SEQ ID NO: 291 - DNA, 70 bp, Artificial Sequence
  Description of Artificial Sequence: Synthetic oligonucleotide
tgacggcgattgagccgacgggtggaaacccaaaacgtaatcaacaagtataaactctgggaggttccta

SEQ ID NO: 292 - DNA, 21 bp, Artificial Sequence
  Description of Artificial Sequence: Synthetic oligonucleotide
atttaatgccggctcatctgg

SEQ ID NO: 293 - DNA, 22 bp, Artificial Sequence
  Description of Artificial Sequence: Synthetic oligonucleotide
gctatctgggtttagccctaaa

The invention claimed is:

1. A genetically engineered non-pathogenic bacterium comprising a non-native gene encoding interleukin (IL)-22, wherein the gene is operably linked to a promoter, and a non-native gene cassette for producing butyrate, wherein the gene cassette is operably linked to a promoter, wherein at least one promoter comprises any one of SEQ ID NOs: 142-157.

2. The bacterium of claim 1, wherein the gene or the gene cassette is located on a chromosome in the bacterium.

3. The bacterium of claim 1, wherein the gene or the gene cassette is located on a plasmid in the bacterium.

4. The bacterium of claim 1, wherein the bacterium is a probiotic bacterium.

5. The bacterium of claim 4, wherein the bacterium is selected from the group consisting of *Bacteroides, Bifidobacterium, Clostridium, Escherichia, Lactobacillus*, and *Lactococcus*.

6. The bacterium of claim 5, wherein the bacterium is *Escherichia coli* strain Nissle.

7. The bacterium of claim 1, wherein the bacterium is an auxotroph in a gene that is complemented when the bacterium is present in a mammalian gut.

8. The bacterium of claim 7, wherein the bacterium is an auxotroph in diaminopimelic acid or an enzyme in the thymidine biosynthetic pathway.

9. A pharmaceutically acceptable composition comprising the bacterium of claim 1; and a pharmaceutically acceptable carrier.

10. The bacterium of claim 1, wherein the gene cassette for producing butyrate comprises a butyrate kinase (buk) gene and a phosphate butyryltransferase (pbt) gene.

11. The bacterium of claim 1, wherein the gene cassette for producing butyrate comprises an acyl-CoA thioesterase (tesB) gene.

12. The bacterium of claim 1, wherein the promoter operably linked to the gene encoding IL-22 and the promoter operably linked to the gene cassette are different promoters.

13. The bacterium of claim 1, wherein the promoter operably linked to the gene encoding IL-22 and the promoter operably linked to the gene cassette for producing butyrate are separate copies of the same promoter.

14. The bacterium of claim 1, wherein the gene cassette comprises bcd2, etfB3, etfA3, thiA1, hbd, crt2, pbt, and buk.

15. The bacterium of claim 1, wherein the gene cassette comprises ter, thiA1, hbd, crt2, pbt, and buk.

16. The bacterium of claim 1, wherein the gene cassette comprises bcd2, etfB3, etfA3, thiA1, hbd, crt2, and tesB.

17. The bacterium of claim 1, wherein the gene cassette comprises ter, thiA1, hbd, crt2, and tesB.

18. A genetically engineered non-pathogenic bacterium comprising a non-native gene encoding interleukin (IL)-22, and a non-native gene cassette for producing butyrate, wherein the gene and the gene cassette are operably linked to the same copy of a promoter comprising any one of SEQ ID NOs: 142-157.

* * * * *